(12) United States Patent
Luirink et al.

(10) Patent No.: US 9,322,011 B2
(45) Date of Patent: Apr. 26, 2016

(54) FUSION PROTEIN FOR SECRETORY PROTEIN EXPRESSION

(75) Inventors: Joen Luirink, Amsterdam (NL); Wouter S. P. Jong, Amsterdam (NL)

(73) Assignee: ABERA BIOSCIENCE AB, Stockholm (SE)

(*) Notice: Subject to any disclaimer, the term of this patent is extended or adjusted under 35 U.S.C. 154(b) by 8 days.

(21) Appl. No.: 13/876,425

(22) PCT Filed: Sep. 28, 2011

(86) PCT No.: PCT/EP2011/066854
§ 371 (c)(1),
(2), (4) Date: Mar. 27, 2013

(87) PCT Pub. No.: WO2012/041899
PCT Pub. Date: Apr. 5, 2012

(65) Prior Publication Data
US 2013/0344099 A1     Dec. 26, 2013

(30) Foreign Application Priority Data
Sep. 28, 2010  (SE) .................................. 10510006

(51) Int. Cl.
*C07K 14/245* (2006.01)
*A61K 35/744* (2015.01)
*C12N 9/96* (2006.01)
*A61K 39/00* (2006.01)
*C12N 15/62* (2006.01)

(52) U.S. Cl.
CPC ............... *C12N 9/96* (2013.01); *A61K 35/744* (2013.01); *C07K 14/245* (2013.01); *C12N 15/625* (2013.01); *A61K 39/00* (2013.01); *A61K 2039/523* (2013.01)

(58) Field of Classification Search
None
See application file for complete search history.

(56) References Cited

U.S. PATENT DOCUMENTS

| | | | |
|---|---|---|---|
| 7,129,060 B1* | 10/2006 | Maurer et al. | 435/69.1 |
| 8,771,669 B1* | 7/2014 | Bermudes | 424/93.2 |
| 2006/0034854 A1* | 2/2006 | Berthet et al. | 424/184.1 |
| 2006/0141563 A1* | 6/2006 | Biemans et al. | 435/69.1 |
| 2006/0263781 A1 | 11/2006 | Dalby-Payne et al. | |
| 2007/0031449 A1* | 2/2007 | Bos et al. | 424/203.1 |
| 2007/0116711 A1* | 5/2007 | Castado et al. | 424/190.1 |

(Continued)

FOREIGN PATENT DOCUMENTS

| | | |
|---|---|---|
| CN | 1761472 A | 4/2006 |
| WO | WO-02/070645 A2 | 9/2002 |

OTHER PUBLICATIONS

Wouter et al. "Limited tolerance towards folded elements during secretion of the autotransporter Hbp" Molecular Microbiology (2007) 63{5}. 1524-1536.*

(Continued)

*Primary Examiner* — Manjunath Rao
*Assistant Examiner* — William W. Moore
(74) *Attorney, Agent, or Firm* — Harness, Dickey and Pierce, P.L.C.

(57) ABSTRACT

There is provided a fusion protein suitable for secretion of more than one polypeptide(s) of interest (POI) comprising a signal peptide, a POI, a passenger domain comprising a beta stem domain from an autotransporter protein, and a translocator domain from an autotransporter protein, wherein the beta stem-forming sequence of the passenger domain is essentially intact and the POI(s) is/are fused to the beta stem domain.

61 Claims, 32 Drawing Sheets

(56) References Cited

U.S. PATENT DOCUMENTS

| | | | |
|---|---|---|---|
| 2007/0134264 A1* | 6/2007 | Marshall | 424/190.1 |
| 2009/0062142 A1* | 3/2009 | Daugherty et al. | 506/9 |
| 2009/0155849 A1* | 6/2009 | Veiga Chacon et al. | 435/69.6 |
| 2011/0014210 A1* | 1/2011 | Caldwell et al. | 424/164.1 |
| 2012/0264144 A1* | 10/2012 | Jose et al. | 435/7.92 |
| 2013/0004510 A1* | 1/2013 | Poolman et al. | 424/164.1 |
| 2014/0011706 A1* | 1/2014 | Schumacher et al. | 506/11 |

OTHER PUBLICATIONS

Dautin, N., et al., 2007, "Cleavage of a bacterial autotransporter by an evolutionarily convergent autocatalytic mechanism", The EMBO Journal, vol. 26, No. 7, pp. 1942-1952.*

Dautin, N., et al., 2007, "Protein secretion in Gram-negative bacteria via the autotransporter pathway", Annual Review of Microbiology, vol. 61, pp. 89-112.*

Barnard, T.L., et al., 2007, "Autotransporter structure reveals intrabarrel cleavage followed by conformational change", Nature Structural & Molecular Biology, vol. 14, No. 12, pp. 1214-1220.*

NCBI Reference Sequence: YP_001481228.1, Tsh [*Escherichia coli* APEC O1] (2013).

Wouter S. P. Jong, et al: "Limited tolerance towards folded elements during secretion of the autotransporter Hbp", Molecular Microbiology, vol. 63, No. 5, Mar. 1, 2007, pp. 1524-1536, XP55015367, ISSN: 0950-382X, DOI: 10.1111/j.1365-2958.2007.05605.x.

Konieczny M. P. J., et al: "Cell surface presentation of recombinant (poly-) peptides including functional T-cell epitopes by the AIDA autotransporter syster", FEMS Immunology and Medical Microbiology, Elsevier Science B.V., Amsterdam, NL, vol. 27, No. 4, Apr. 1, 2000, pp. 321-332, XP002231688, ISSN: 0928-8244, DOI: 10.1016/S0928-8244(99)000210-2, p. 325; figure 1 p. 331.

Jose J., et al: "The autodisplay story, from discovery to biotechnical and biomedical applications", Microbiology and Molecular Biology Reviews, American Society for Microbiology, US, vol. 71, No. 4, Dec. 1, 2007, pp. 600-619, XP002577399, ISSN: 1092-2172, DOI: 10.1128/MMBR.00011-07.

Jong W. S., et al: "Extracellular production of recombinant proteins using bacterial autotransporters", Current Opinion in Biotechnology, London, GB, vol. 21, No. 5, Oct. 1, 2010, pp. 646-652, XP027389136, ISSN: 0958-1669 [retrieved on Oct. 5, 2010].

International Search Report for PCT/EP2011/066854, mailed Dec. 30, 2011 and International Preliminary Report on Patentability with 13 annexed sheets, mailed Jan. 21, 2013 (both in English).

Otto, B., et al. (2005), "Crystal Structure of Hemoglobin Protease, a Heme Binding Autotransporter Protein from Pathogenic *Escherichia coli*", The Journal of Biological Chemistry, 280(17): 17339-17345.

Office Action dated Mar. 10, 2015 issued in Chinese Application No. 201180046204.3—English translation only provided.

Nishimura, K., et al. (2010), "Autotransporter passenger proteins: virulence factors with common structural themes", *J Mol Med*, 88: 451-458.

Nishimura, K., et al. (2010), "Role of domains within the autotransporter Hbp/Tsh", *Biological Crystallography*, D66: 1295-1300.

International Preliminary Report on Patentability dated Jan. 21, 2013 issued in PCT Patent Application No. PCT/EP2011/066854.

* cited by examiner

A

B

FUSION PROTEIN FOR SECRETORY PROTEIN EXPRESSION

CROSS-REFERENCE TO RELATED APPLICATIONS

This application is a 371 U.S. National Stage of International Application No. PCT/EP2011/066854, filed on Sep. 28, 2011 and published in English as WO/2012/041899 on Apr. 5, 2012. This application claims priority to Swedish Patent Application No. 1051000-6, filed on Sep. 28, 2010. The contents of the above applications are incorporated herein by reference in their entirety

TECHNICAL FIELD

The present invention relates generally to a novel fusion protein and a method for secretory protein expression.

BACKGROUND ART

Secretory protein expression is the expression of a protein in a host cell, where the protein is exported to the cell membrane and is either solubly released into the medium or remains attached to the cell membrane. Secretory protein expression is mediated by a signal peptide at the N-terminus of the protein which directs the polypeptide to the membrane.

Usually, recombinant proteins that are produced in prokaryotic hosts such as E. coli are produced intracellularly. When the protein is recovered in such a procedure, the cells have to be lysed which leads to contamination of the recombinant protein with cellular content. The protein then has to be recovered from whole cell extracts in multi-step purification procedures, which is time consuming and results in poor yields.

Secretion of recombinant proteins into the medium is a better strategy because purification of proteins from spent medium is easier and more compatible with continuous culturing. However, the present systems do not have efficient yields.

Secretory protein expression where the protein remains attached to the cell surface has other uses. Examples of use for this type of protein expression include live-vaccine development, epitope mapping, biosorbent and biosensor development and the high throughput screening of protein and peptide libraries for drug discovery.

In both surface display and secretion, recombinant proteins face the challenge of translocation across the complex E. coli cell envelope that consists of two lipid membranes (the inner and outer membrane) with a gel-like compartment, the periplasm, in between. This has been shown to be very difficult and the methods previously used have had low efficacy.

Autotranporters are large proteins that are secreted by Gram-negative bacteria, such as E. coli. The autotransporter system is simple in the sense that the autotransporter, as implied by its name, is suggested to carry all information for translocation across the periplasm and outer membrane within the protein itself. However, the mechanism whereby autotransporters are secreted is still not completely understood.

Autotransporters are synthesized as large precursor proteins that contain three main domains: (i) an N-terminal signal peptide that targets the protein to the Sec translocon and initiates transfer across the inner membrane, (ii) a passenger domain which comprises the "cargo" protein that is to be secreted and (iii) a C-terminal pore-forming domain (translocator domain) comprising a beta barrel structure that integrates into the outer membrane and plays a crucial but unclear role in translocation of the passenger domain across the outer membrane into extracellular space.

After translocation, the passenger domain is cleaved from the translocator domain and is released into the extracellular environment. In some cases, the passenger domain remains non-covalently attached to the cell surface. Cleavage can be achieved by the action of an (external) protease on a protease motif situated between the translocator domain and the passenger domain. Alternatively, cleavage takes place through an intramolecular autocatalytic event at a specific site between the translocator domain and the passenger domain.

The passenger domain of an autotransporter comprises a beta stem structure and side domains. The beta stem is an elongated structure formed by an extended beta helix. The C-terminus of the passenger domain comprises an autochaperone domain which has been implicated in both passenger folding and translocation across the outer membrane.

Hbp is an autotransporter protein that belongs to the subfamily of serine protease autotransporters of Enterobacteriaceae (SPATEs). The crystal structure of the passenger domain of Hbp has recently been determined (Otto et al. 2005 J Biol Chem 280(17): 17339-45), and is shown as FIG. 11A. The structure shows that the polypeptide forms a long right-handed beta-helical structure ("beta stem"). The passenger domain of the Hbp comprises two larger side domains, domain d1 and domain d2, of which d1 comprises the serine proteinase activity of the protein and d2 has an unknown function. There are also three smaller side domains, domain 3 (d3), domain 4 (d4) and domain 5 (d5).

Similar beta stem domains have been shown also for other autotransporters such as pertactin (Emsley et al 1996 Nature 381: 90-92) and IgA protease (Johnson et al 2009 J Mol Biol 389(3): 559-74).

There have been previous attempts in using autotransporters for secretory protein expression in E. coli, mostly using variants of the Neisserial IgA protease (Pyo et al 2009 Vaccine 27 2030-2036) and the endogenous E. coli autotransporter AIDA-I (Van Gerven et al 2009 Microbiology 155: 468-476) that were engineered for surface display purposes.

Efforts using IgA protease and AIDA-I for secretion of recombinant proteins used constructs which resulted in poor yields of secreted and surface exposed protein (Pyo et al 2009 Vaccine 27 2030-2036; Van Gerven et al 2009 Microbiology 155:468-476). In the majority of such studies the complete, or almost complete, endogenous passenger domain was replaced by the recombinant protein.

So far, autotransporters have mainly been used as a display platform rather than for secretion of heterologous proteins in soluble form, where the protein is secreted into the medium.

IgA protease requires an accessory protease for processing whereas AIDA-I remains non-covalently attached to the outer membrane after cleavage. Thus, these autotransporters can only be used for surface presentation of epitopes and proteins.

Efficient display and secretion of calmodulin fused the passenger of Hbp has previously been shown (Jong et al 2007 Molecular Microbiology 63:1524-1536). In order to minimize perturbation of the native β-stem of the passenger, calmodulin replaced domain 2 of the Hbp passenger.

For certain applications the possibility to secrete or display more than one protein of interest (POI) from/on the cell surface is very useful. Such applications include vaccines, for example in which two or more epitopes are displayed on the same cell surface, enzyme display, in which more than one enzyme is displayed on the cell surface in order to carry out a range of catalytical reactions in a series of steps, exposure of peptide libraries and inhibitor screening.

For multivalent vaccines it is particularly useful to have a system wherein one population of host cells can express and display or secrete multiple antigens, rather than having a mixture of cell populations, each displaying or secreting only one of the antigens. Having only one cell population displaying or secreting multiple antigens has the advantage of easier production and better control of the vaccine content.

In conclusion, there is a need for improved secretory expressions systems for the display of heterologous proteins as well as secretion of heterologous proteins in soluble form into the culture medium. There is also a need for a system and a method that enable secretory protein expression of more than one protein of interest on the cell surface of a host cell or secretion of more than one protein into the culture medium.

OBJECT OF THE INVENTION

An object of the present invention is to provide efficient secretion of a polypeptide of interest (POI) from a host cell.

A second object of the invention is to provide efficient display of a POI on the surface of a host cell.

A third object of the invention is to provide efficient soluble secretion of a POI into the medium in which a host cell is cultured.

Yet another object of the invention is to provide a scaffold for efficient secretion, i.e. display or soluble secretion, of more than one POI.

SUMMARY OF THE INVENTION

In a first aspect of the invention there is provided a host cell capable of expressing more than one, such as at least two, POI:s (proteins of interest). The POI:s are comprised in a fusion protein that also comprises a passenger domain comprising a beta stem domain from an autotransporter protein, a translocator domain from an autotransporter protein, and a signal peptide that is able to target the fusion protein to the inner membrane of Gram negative bacteria. The beta stem forming sequence of the passenger domain is essentially intact and the POI:s are fused to the passenger domain.

This host cell for secretory protein expression has several advantages, including but not limited to more efficient secretion of more than one POI, compared to other systems. Also, when the goal is to display the POI, the beta stem domain will enable a more efficient display as the POI:s will be further away from the cell surface and be more stable.

In one embodiment of the host cell of the present invention, the native form of the passenger domain of the autotransporter comprises at least one side domain that protrudes from the beta stem domain. The POI:s may then be inserted into, replace or partly replace such side domain.

In another embodiment the native form of the passenger domain of the autotransporter comprises at least two side domains. Each POI may then be inserted into, replace or partly replace a separate such side domain, or the POI:s may be inserted into, replace or partly replace the same side domain.

The POI:s may also be fused to an independent passenger domain, translocator domain and signal peptide from an autotransporter.

In a second aspect of the invention there is provided a fusion protein comprising more than one, such as at least two, POI:s (proteins of interest), a passenger domain comprising a beta stem domain from an autotransporter protein, a translocator domain from an autotransporter protein, and optionally, a signal peptide that targets the fusion protein to the inner membrane of a Gram negative bacteria. The beta stem forming sequence of the passenger domain is essentially intact and the POI:s are fused to the passenger domain.

The passenger domain of the fusion protein may in its native form comprise at least one side domain protruding from the beta stem domain, and the POI:s may be inserted onto, replace or partly replace such side domain. The passenger domain of the fusion protein may also in its native form comprise at least two side domains, and each POI may be inserted into, replace or partly replace independent domains of such side domains. Alternatively the POI:s may be inserted into, replace or partly replace the same side domain.

In another aspect of the invention there is provided a nucleic acid arranged for expression of a fusion protein. In one embodiment the nucleic acid comprises, in frame, sequence encoding a signal peptide of the fusion protein, that is able to target the fusion protein to the inner membrane of Gram negative bacteria, sequence encoding a passenger domain of the fusion protein, that comprises a beta stem domain from an autotransporter protein, and sequence encoding a translocator domain of the fusion protein, that derives from an autotransporter protein. The sequence encoding the passenger domain comprises at least two stretches of cloning site sequence that allow in-frame cloning of at least two DNA sequences that encode POI:s (proteins of interest). The cloning site sequences are arranged such that the encoded beta stem forming protein sequence of the passenger domain is essentially intact. It is also possible to insert POI:s into an autotransporter by merely fusing two pieces of DNA, e.g. by PCR, without using cloning sites thereby creating a fusion protein.

The sequence encoding the passenger domain of the autotransporter may in its native form comprise at least two stretches of sequence encoding side domains protruding from the beta stem domain. The at least two stretches of cloning site sequence may then be inserted into, replace or partly replace separate of such stretches encoding side domains.

In another embodiment the nucleic acid comprises, in frame, sequence encoding a signal peptide of the fusion protein, that is able to target the fusion protein to the inner membrane of Gram negative bacteria, sequence encoding a passenger domain of the fusion protein, that comprises a beta stem domain from an autotransporter protein, sequence encoding a translocator domain of tha fusion protein, that derives from an autotransporter protein, and sequences encoding at least two POI:s of the fusion protein. The sequences encoding the POI:s are fused to the sequence encoding the passenger domain and are arranged such that the encoded beta stem forming protein sequence of the passenger domain is essentially intact.

The sequence encoding the passenger domain of the autotransporter in its native form may comprise at least two stretches of sequence encoding side domains protruding from the beta stem domain. Each of the at least two sequences encoding POI:s may then be inserted into, replace or partly replace each of the stretches encoding side domains.

The host cell, fusion protein or nucleic acid may be arranged such that the fusion protein, when expressed, is secreted from the cell surface. For instance, the fusion protein may comprise a cleavage site that allows the fusion protein to be cleaved and secreted from a host cell expressing the fusion protein. And the nucleic acid encoding the fusion protein may encode such a cleavage site.

Alternatively, the host cell, fusion protein or nucleic acid may be arranged such that the fusion protein, when expressed, is displayed at the cell surface. For instance the fusion protein may comprise no such cleavage site or may comprise a disrupted cleavage site. Similarly the nucleic acid encoding the fusion protein then encodes no such a cleavage site or encodes a disrupted cleavage site. Alternatively, the fusion protein and nucleic acid may comprise a cleave site and the resulting fusion protein be cleaved, but remains non-covalently attached to, and thus displayed at, the cell surface.

The passenger domain and the translocator domain may be derived from a SPATE (serine protease autotransporters of Enterobacteriaceae) protein, such as Hemoglobin-binding protease (Hbp), extracellular serine protease (EspC) or temperature-sensitive hemagglutinin (Tsh) from *Escherichia coli*.

In one aspect of the invention there is provided a vector comprising a nucleic acid of the invention.

In another aspect of the invention there is provided a host cell comprising a nucleic acid or a vector of the invention.

In one embodiment the host cell of the invention is a Gram negative bacterium, which may be selected from the family of Enterobacteriaceae, such as *Escherichia coli, Salmonella* spp., *Vibrio* spp., *Shigella* spp., *Pseudomonads* spp., *Burkholderia* spp. or *Bordetella* spp.

In one aspect there is provided an outer membrane vesicle displaying a fusion protein according to the invention. In another aspect there is provided a bacterial ghost displaying a fusion protein according to the invention.

In one aspect there is provided a method for secretory protein expression of a fusion protein, comprising the steps of providing a host cell according to the invention and inducing expression of the fusion protein.

In one embodiment the method comprising the additional step of inhibiting a periplasmic enzyme, such as DegP, with protease activity in the host cell. DegP may for example be inhibited by a mutation in its catalytic site.

In another embodiment the method comprises the additional step of down regulating at least one enzyme, such as DsbA or DsbB, that catalyzes the formation of disulphide bonds in proteins in the periplasmic space of the host cell.

The method may provide secretion of the fusion protein in a soluble manner. Alternatively it may provide display of the fusion protein on the cell surface.

In one embodiment the method comprises the additional step of inducing shedding of vesicles from the outer membrane of the host cell, being a Gram negative bacterium, thus forming outer membrane vesicles displaying the fusion protein on their surface.

In another embodiment the method comprises the additional step of lysing the Gram negative bacterium, thus forming bacterial ghosts displaying the fusion protein on their surface. The lysing may be made by use of the lethal lysis gene E from bacteriophage PhiX174.

In one embodiment at least one of the POI:s may comprise an antigen, for example from an infectious organism. The antigen is for example an antigen from *Mycobacterium tuberculosis*, such as ESAT-6, Ag85B, Rv2660c, TB10.4 and TB10.3, or a protein that is similar to those proteins.

In one aspect there is provided a vaccine comprising a host cell, a fusion protein, an outer membrane vesicle or a bacterial ghost according to the invention.

BRIEF DESCRIPTION OF FIGURES

The invention is now described, by way of example, with reference to the accompanying figures, in which:

FIG. 11 E shows various constructs of fusion proteins used in examples 1-15.

DEFINITIONS

Figure 1:
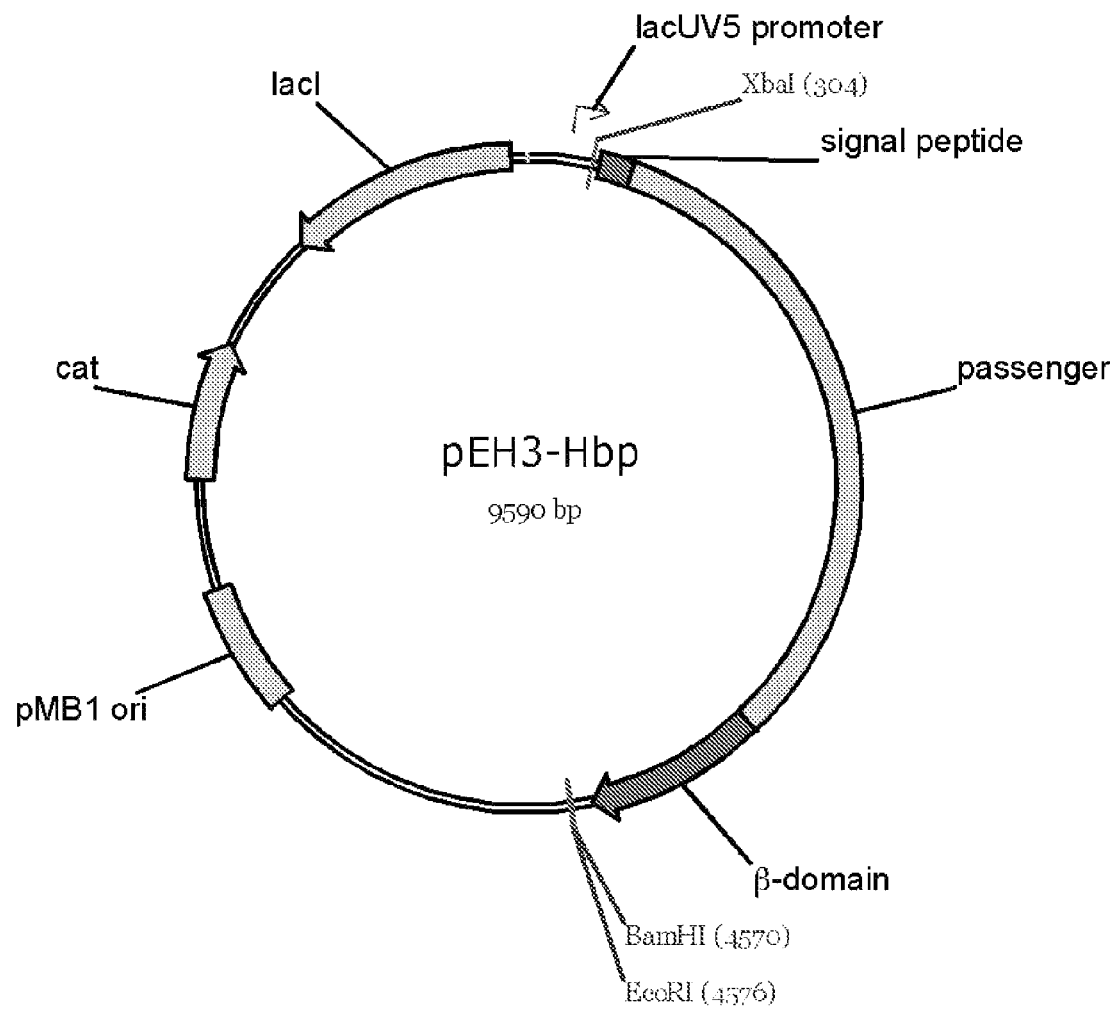
FIG. 1-10 show plasmid maps of plasmids used in the examples.
Figure 2:
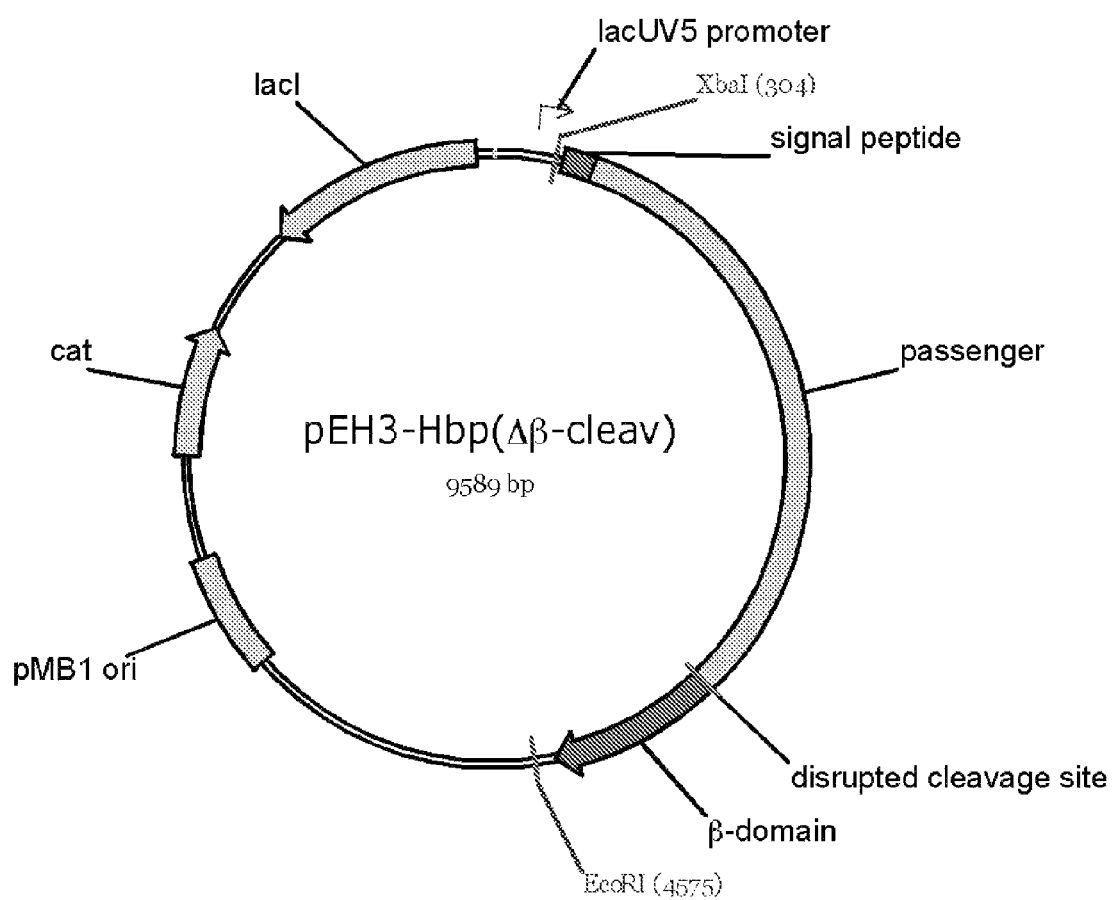
Figure 3:
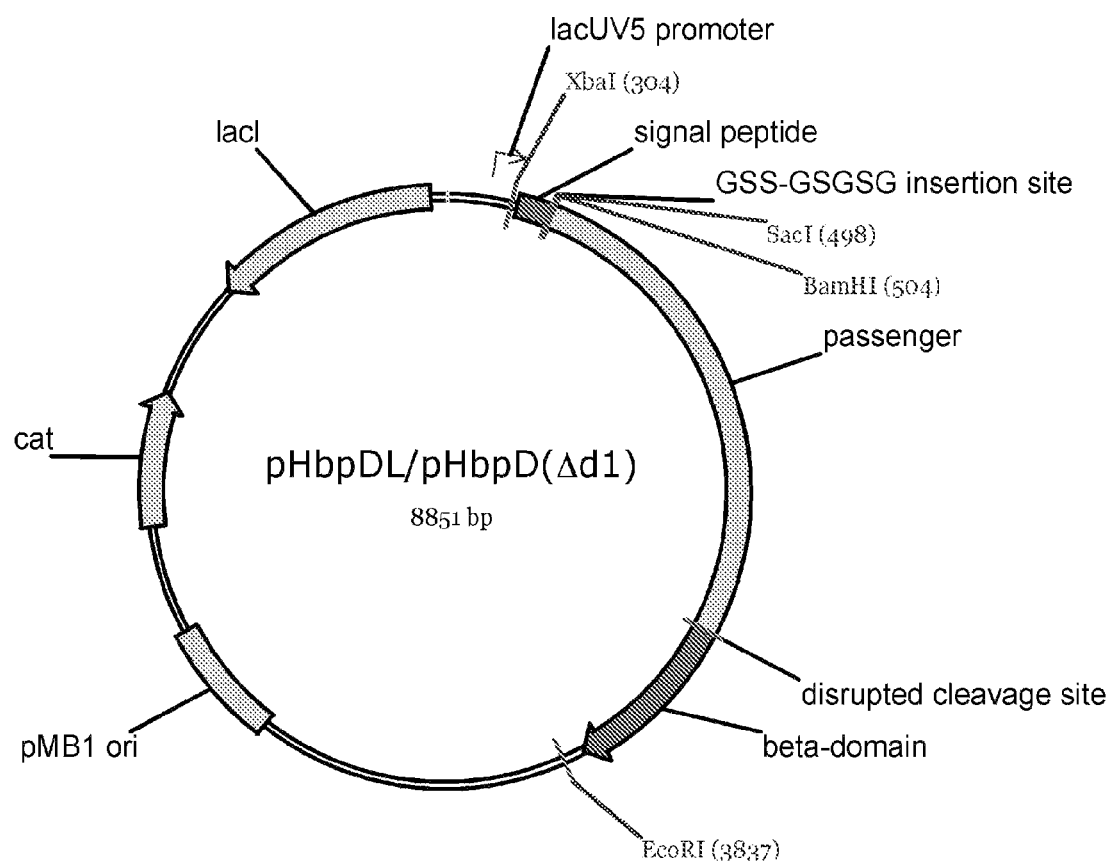
Figure 4:
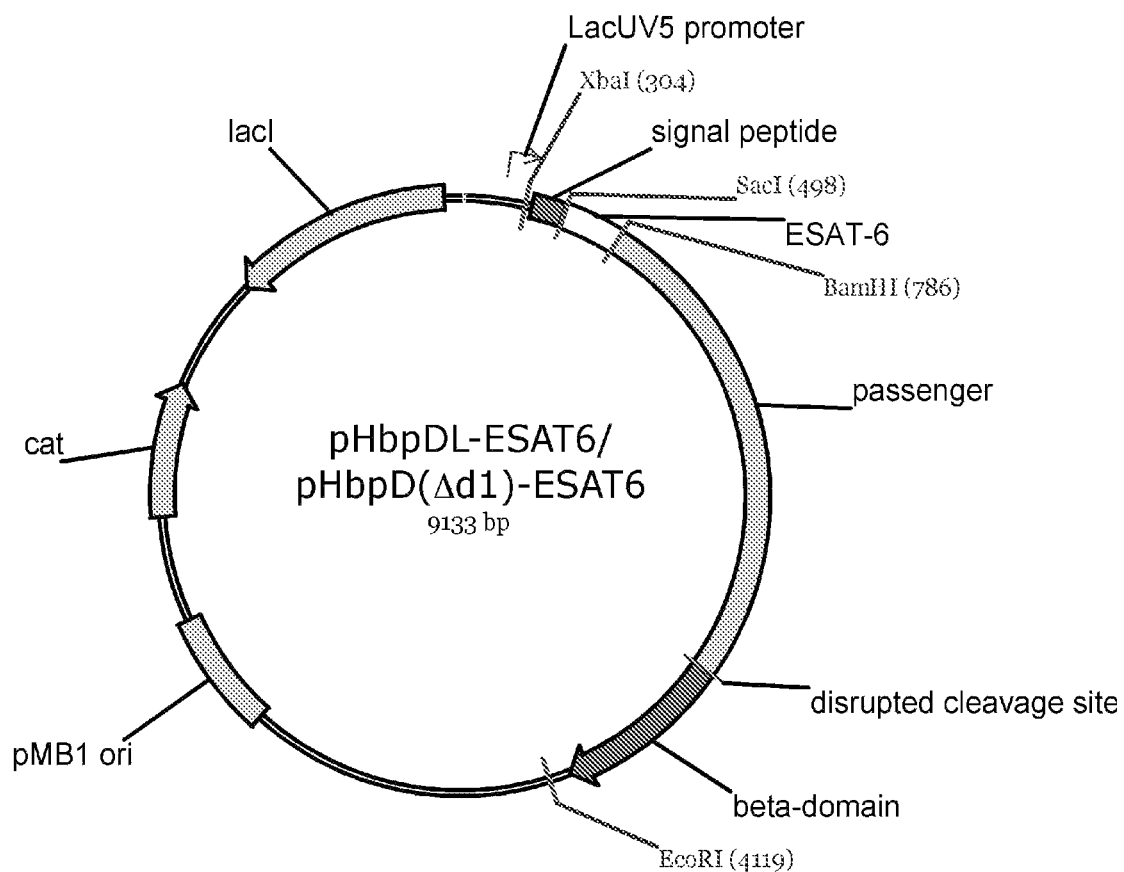
Figure 5:
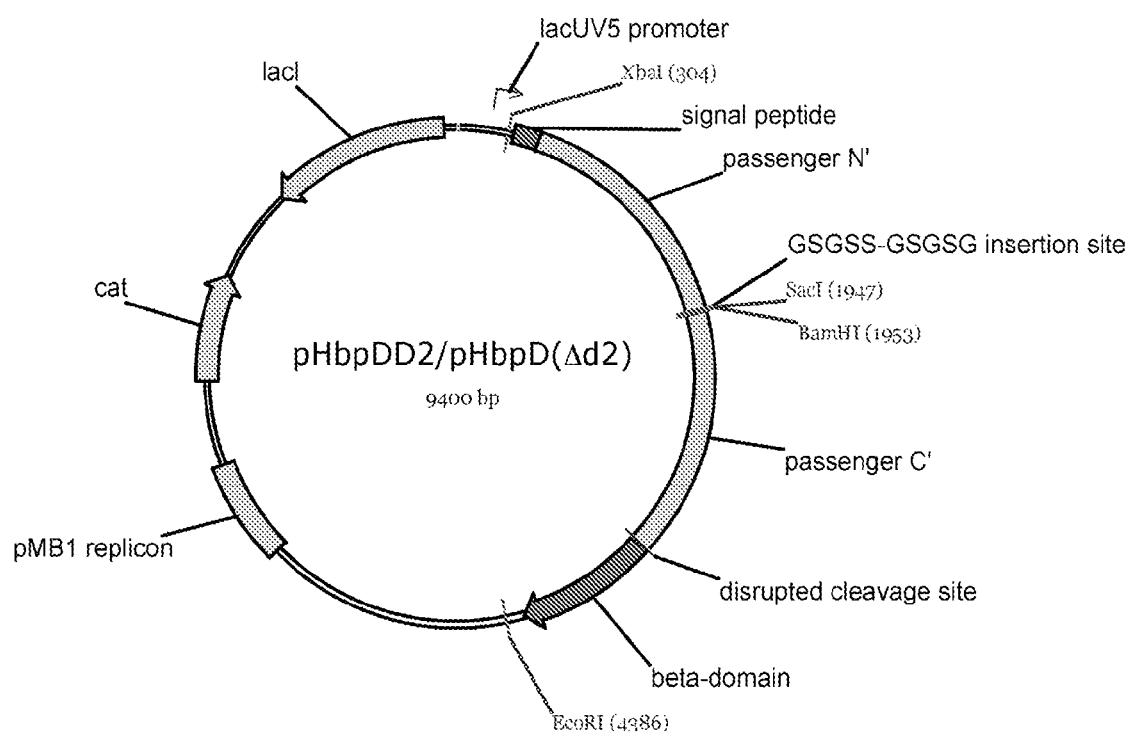
Figure 6:
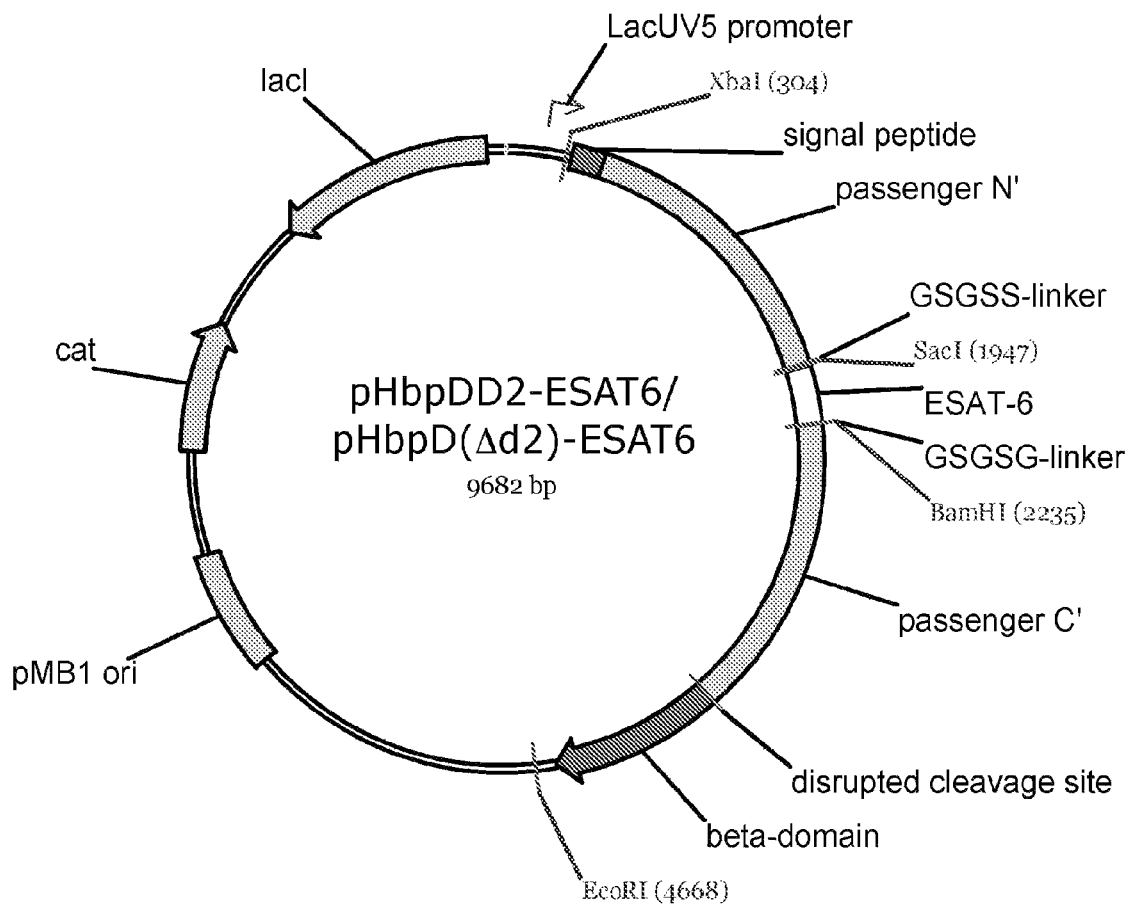
Figure 7:
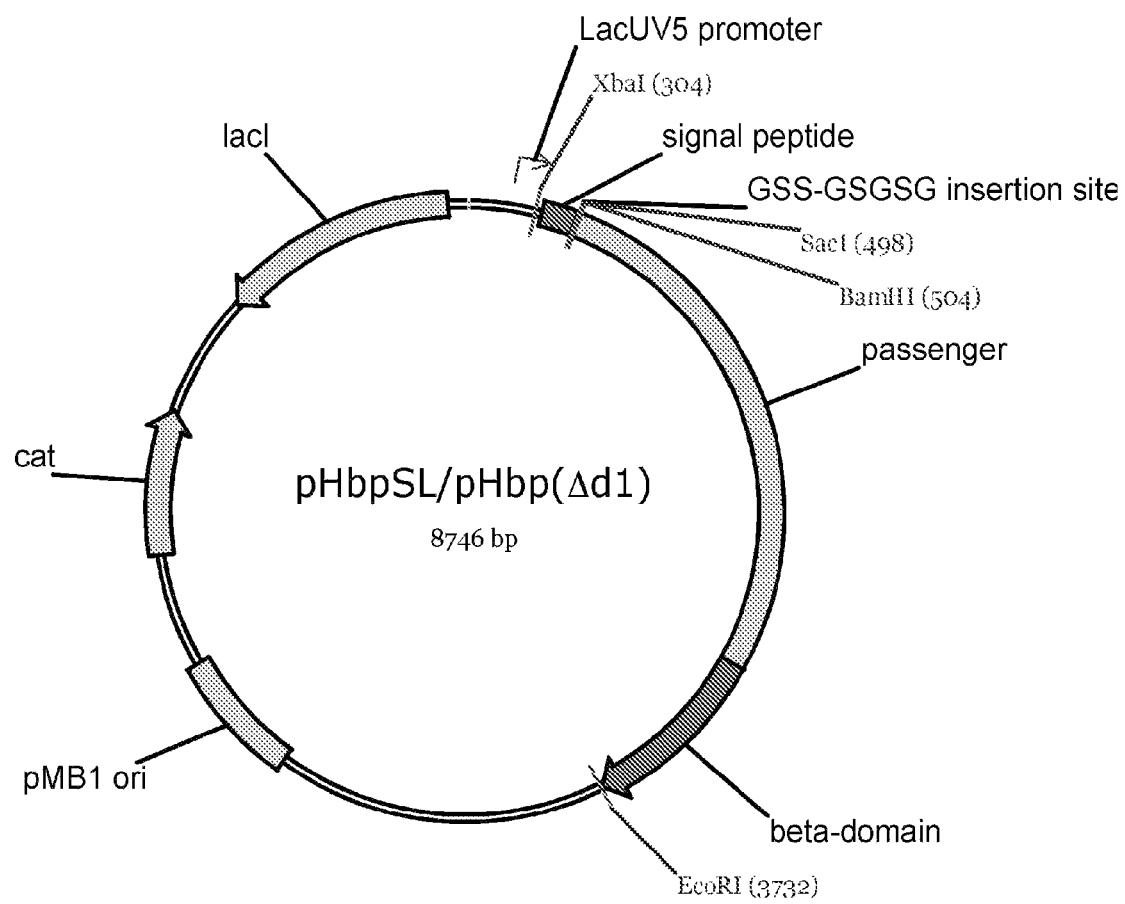
Figure 8:
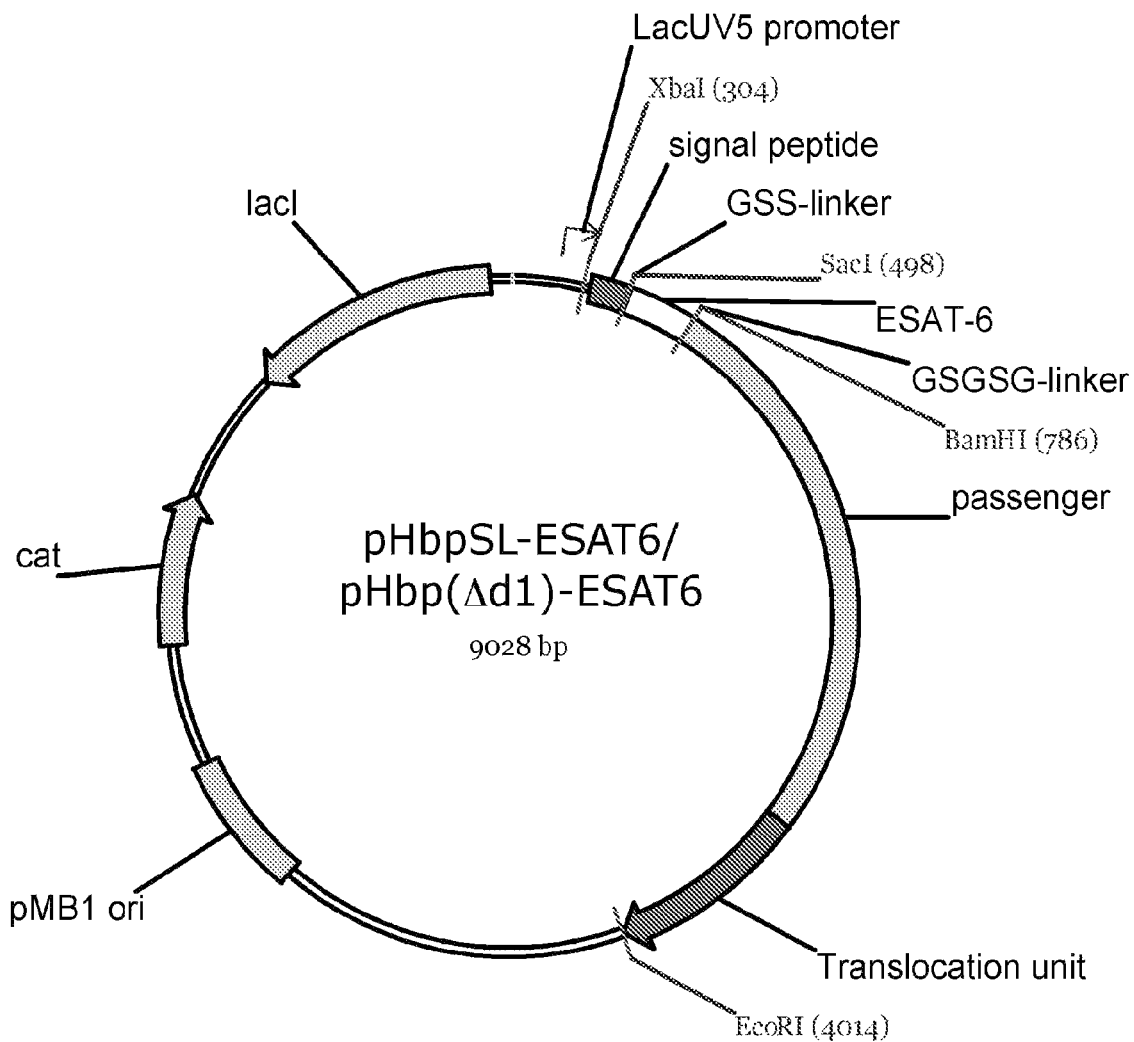
Figure 9:
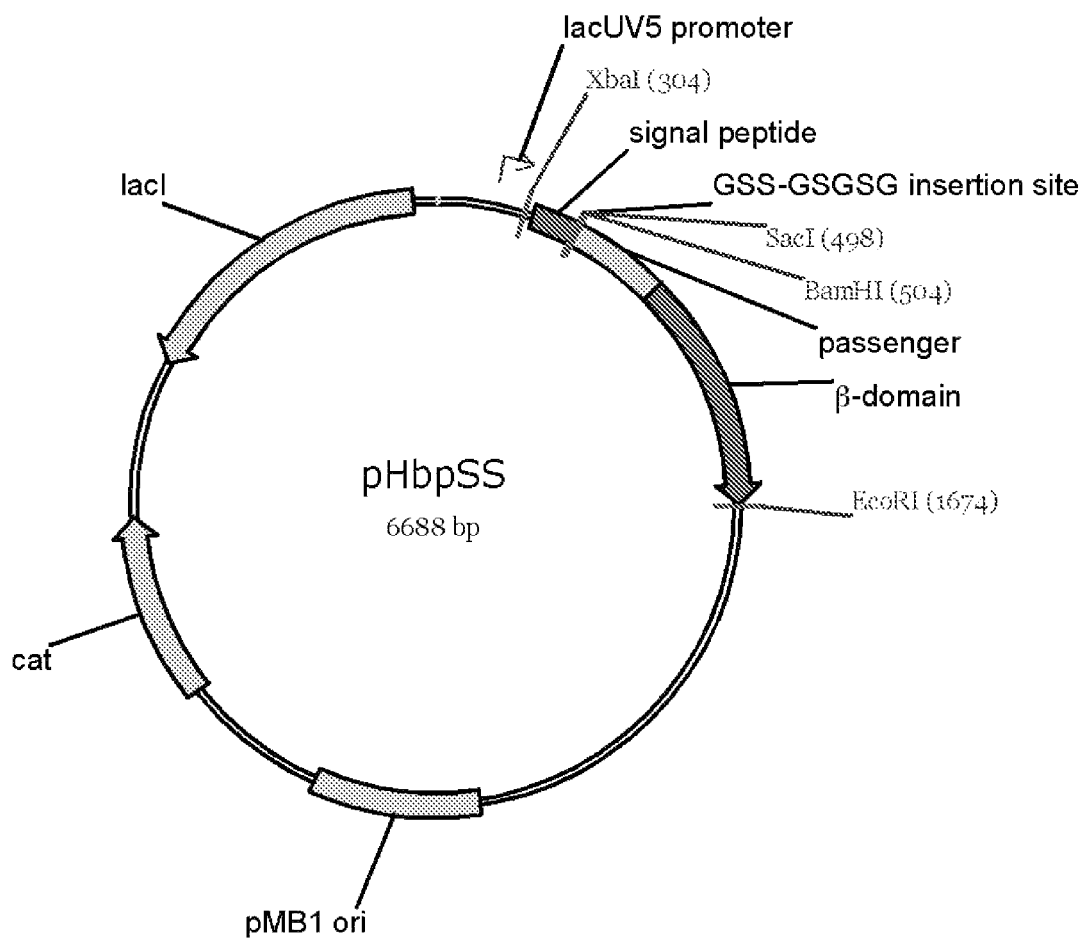
Figure 10:
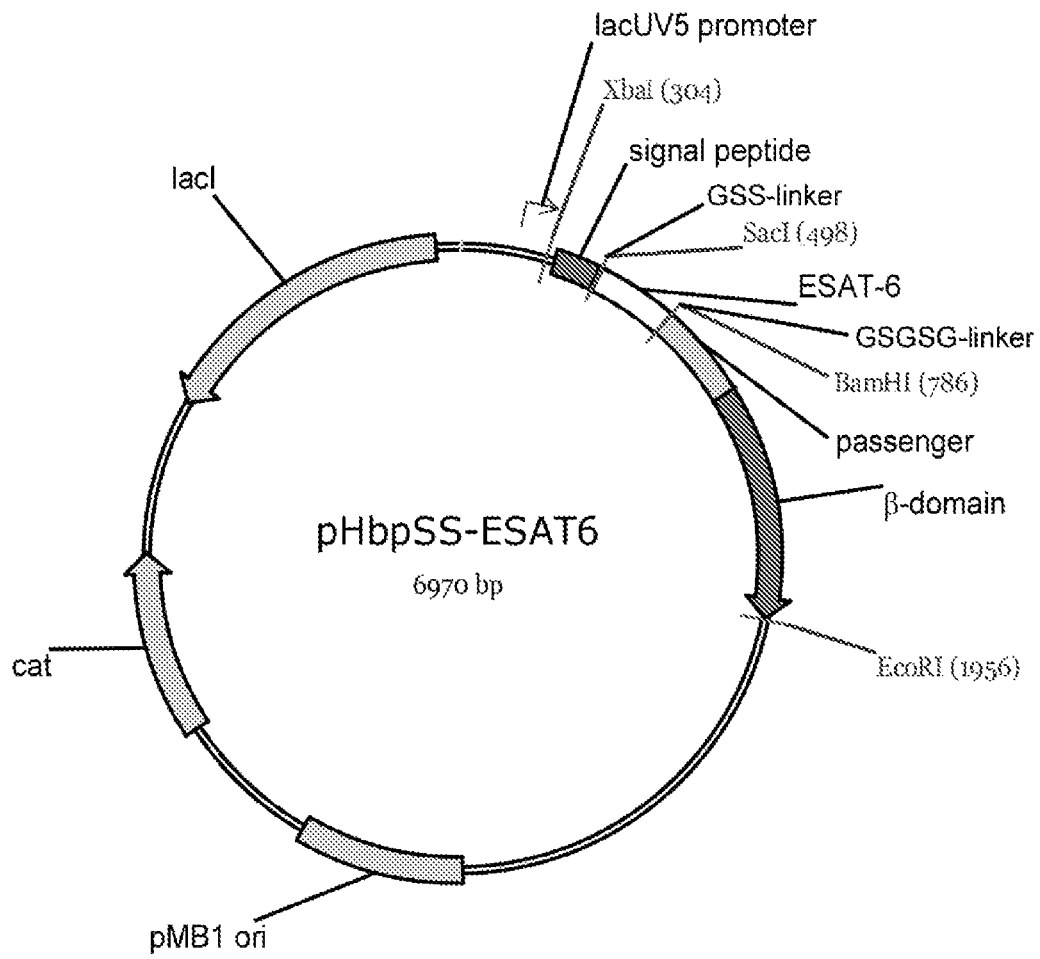

As used herein, the following definitions are supplied in order to facilitate the understanding of the present invention.

An "autotransporter" is a protein that belongs to the pfam autotransporter family ('Autotransporter' PF03797) and that also is known or predicted to form a beta stem motif. The BETAWRAPPRO method for sequence analysis can be used to predict if the passenger domain of an autotransporter will form a beta stem motif (Junker et al 2006 Proc Natl Acad Sci USA 103(13): 4918-23).

A "polypeptide of interest" (POI) is a polypeptide that a host cell secretes in soluble form into the medium or displays on the cell surface, or both. The POI is also heterologous to the autotransporter domains to which it is fused. The POI is at least 4 amino acids long, at least 10 amino acids long or at least 20 amino acids long.

"Beta stem forming sequence" refers to the sequence of a passenger domain of an autotransporter that forms a beta stem structure. The beta stem forming sequence of a passenger can be identified using crystal structure determination. As described above the beta stem forming sequence may alternatively be identified using the M4T homology modeling method (Rykunov et al 2009 J Struct Funct Genomics 10: 95-99) or similar prediction methods.

A "side domain" is a domain that is part of the passenger domain but is not part of the beta stem. Typically, a side domain is located in the passenger domain between two stretches of beta stem forming sequence. A side domain starts at the first amino acid after the preceding beta strand and it ends one amino acid before the starting amino acid of the beta strand following the side domain. The side domain can also be located at the N-terminus of the passenger domain. Autotransporters may have several side domains.

"Similar protein", "similar sequence" or a "like protein" refers to a protein that has a high degree of homology to another protein when the two amino acid sequences are compared. Preferably, it is at least 80%, more preferably more than 90%, more preferably more than 95%, even more preferably more than 97% homologous to the comparative sequence when the two sequences are optimally aligned. Sequence homology can be readily measured using public available software such as BLAST.

"Host cell" refers to a prokaryotic cell into which one or more vectors or isolated and purified nucleic acid sequences of the invention have been introduced. It is understood that the term refers not only to the particular subject cell but also to the progeny or potential progeny of such a cell. Because certain modifications may occur in succeeding generations due to either mutations or environmental influences, such progeny may not, in fact, be identical to the parent cell, but are still included within the scope of the term as used herein.

"Displayed": A secreted protein is displayed on the surface of the secreting host cell when it remains associated with the outer membrane of the host cell such that it at least partly protrudes outside the cell. The secreted protein may be attached to the cell membrane or a component that resides therein (such as the translocator domain from an autotransporter) in a covalent or non-covalent manner.

"Soluble secretion" and "secretion in a soluble manner" refers to secretion of a protein where the protein is secreted into the extracellular space so that is not associated with the host cell as opposed to when the protein remains associated to the outer membrane of the host cell, or a protein that is integrated into the outer membrane of the host cell.

"Approximately" indicates a deviation of +/−10% of the stated value, where applicable.

DESCRIPTION

The inventors have found that an autotransporter protein can be used for improved secretory protein expression if the beta stem forming sequence of the passenger domain of the autotransporter is essentially intact. Whereas the actual beta stem-forming sequence is essential for optimal secretion, the side domains of the passenger domain of autotransporters are suitable sites for the insertion of a POI. The side domains can be replaced by a POI which will then be secreted. Alternatively, the POI can be inserted so as to replace a part of the side domain or so as to be fused to a side domain.

The inventors have also found that an autotransporter protein can be used for improved secretory protein expression of more than one, such as at least two, POI:s if the beta stem forming sequence of the passenger domain of the autotransporter is essentially intact. By fusing, i.e. inserting, replacing or partly replacing, the POI:s to one or more side domains of the passenger, while keeping the beta stem structure intact, an efficient and relatively easy-to-use system for simultaneous display or soluble secretion of two or more POI:s is achieved.

The side domains that can be replaced according to the invention are relatively large, such as 20, 30, 40, 60, 80 or more amino acid residues.

Thus, the passenger domain of an autotransporter can be considered as several sections of beta stem forming sequence linked together by non-beta stem forming sequences. These non-beta stem forming sequences are suitable sites for insertion of one or more POI:s. Thus, the POI can be placed in between two parts of beta stem forming sequence. The POI can also be fused to the N-terminus of the passenger domain.

Suitable methods for detecting beta stem forming sequence and side domains of passenger domains of autotransporters include biophysical methods such as as x-ray crystallography and bioinformatics software such as structure prediction tools.

X-ray crystallography is today a standard procedure that is highly efficient and automatized and is known to a person skilled in the art. Examples of high resolution structures of passenger domains and suitable methods for determination of structures of the passenger domain of autotransporters are found in (Otto et al 2005 J Biol Chem 280(17):17339-45; Emsley et al 1996 Nature 381: 90-92; Johnson et al 2009 J Mol Biol 389(3): 559-74).

An example of a bioinformatics method that is suitable for determining beta stem structure is the M4T homology modeling method (Rykunov et al 2009 J Struct Funct Genomics 10: 95-99), which is available for free on the internet.

Where a three-dimensional model of the protein is used for the identification of beta stem domains and side domains, it is suitable that the model obtained has a resolution of better than 4 angstrom. Side domains will then be visible as domains that protrude from the beta stem. By observation of the structure of the passenger domains of autotransporters it can be seen that parts of the sequence are not part of the beta stem but form domains that protrude from the beta stem.

These methods can be used for determining which domains or amino acids of the passenger domains that are suitable for insertion of a POI and which should be kept essentially intact.

The beta stem forming sequence is essentially intact according to the invention. Thus, as little as possible of the beta stem forming sequence should be removed. Predicted domain border is of help to determine where the POI(s) should be inserted. If too much of the beta stem forming sequence is removed, secretion will be negatively affected. That the beta stem forming sequence is essentially intact means that the efficiency of the secretory function of the protein is maintained at an optimal level, as compared to when the beta stem is disrupted or completely removed. It also means that the stability of the passenger after secretion is maintained. A person skilled in the art can use experimental methods to determine if a particular constructs allows efficient secretion.

Examples of methods suitable for determining the efficiency of secretion in vitro include: analysis of the fraction of POI present in the medium, labeling of surface proteins with biotin or other labels, cell fractionation, exposure of surface proteins to proteases (such as proteinase K) and studies using antibodies against the POI (such as dot blot studies, immunofluorescene microscopy and immuno-electron microscopy).

Examples of methods suitable for determining the stability of the passenger after secretion include SDS-PAGE, western blotting and all of the above under paragraph 76.

Thus, by using structural information, a person skilled in the art can predict where in the passenger domain the insertion of the POI can be made in order to maintain optimal secretion. Actual secretion can be easily determined with in vitro experiments.

According to the invention the POI is fused to the passenger domain. This means that the POI is fused to the peptide that forms the passenger domain such that they form one continuous polypeptide. Because design of the fusion protein is carried out at the DNA level, care must be taken so that the reading frame of the POI is the same as the reading frame of the passenger domain.

Preferably the POI has a molecular weight of less than 200 kD. More preferably the molecular weight is less than 200 kD such as 100, 80, 60, 40, 30, 20, 10 or 5 kD.

The fusion protein can comprise more than one POI. Thus, the fusion protein can comprise two, three or more polypeptides of interest. The fusion protein can be such that it has at least two POIs that each replaces, or partly replaces, or is fused to, a separate or independent side domain of the passenger domain. Alternatively, two or more POIs can be fused to, or replace, or partly replace the same side domain.

The fusion protein is encoded by a nucleic acid and expressed in a host cell. The nucleic acid can be constructed with the use of standard molecular biology techniques involving restriction enzymes, DNA ligases, PCR, oligonucleotide synthesis, DNA purification and other methods well-known to a person skilled in the art. Preferably, the starting point is a reading frame of an autotransporter protein into which a DNA fragment encoding the POI is inserted so that the reading frames match. Alternatively, the reading frame for the fusion protein can be designed in silico and synthesized using polynucleotide synthesis.

The reading frame encoding the fusion protein is preferably inserted in an expression vector for prokaryote expression carrying a promoter and other components well known to a person skilled in the art.

The fusion protein comprises an N-terminal signal peptide that directs the protein for secretion. When the host cell is a Gram negative bacteria the signal peptide suitable is such that it directs translocation of the protein across the inner membrane. The signal peptide can be derived from an autotransporter protein, suitably the same autotransporter from which the passenger domain is derived. The signal peptide can comprise approximately amino acids 1 to 52 of SEQ ID NO 1, or a similar sequence.

The fusion protein suitably comprises an autochaperone domain, suitably from the passenger domain of the autotransporter protein used to fuse the POI. One example of an autochaperone domain comprises approximately amino acids 1002 to 1100 of SEQ ID NO 1.

The fusion protein can comprise a passenger domain from one type of autotransporter and a translocator domain from another type of autotransporter.

The autotransporter used in the invention can be an autotransporter with a serine protease domain, such as a serine protease.

The autotransporter can be a SPATE protein (Serine protease autotransporters of the Enterobacteriaceae). Thus, the translocator domain and the passenger domain can be from a SPATE protein. In one embodiment the SPATE protein is one of Hemoglobin-binding protease (Hbp) (SwissProt O88093) and temperature-sensitive hemagglutinin (Tsh) (SwissProt Q47692) from E. coli. The sequence of Tsh is homologous to that of Hbp.

Other SPATE proteins include IgA protease of Neisseria gonorrhoeae and Haemophilus influenzae, EspC from E. coli, Pet from E. coli, EspP from E. coli, Pic from E. coli, PicU from E. coli, Sat from E. coli, Vat from E. coli, EspI from E. coli, EaaA from E. coli, EaaC from E. coli, EatA from E. coli, EpeA from E. coli, PssA from E. coli, AidA_B7A from E. coli, Boa from Salmonella bongori, SepA from Shigella flexneri, SigA from Shigella flexneri, Pic from Shigella flexneri.

The SPATE protein can comprise the polypeptide of SEQ ID NO 1, which is Hbp, or SEQ ID NO 2, which is Hbp where the cleavage site between the translocator domain and the passenger domain has been disrupted (Hbp delta-cleav) or a sequence that is similar to those sequences. Preferably the identity is more than 80%, even more preferably more than 90%, even more preferably more than 95% and most preferably more than 97% to those sequences.

The SPATE group of proteins has several advantages for use with the present invention. First of all some of their structures are known, facilitating the identification of their beta stem and side domains. This knowledge can also be used for prediction of side domains and beta stem structures of related SPATEs for which the crystal structure is not known. Another advantage is their cleavage structure that can be used for efficient soluble secretion, and that is conserved within the SPATE family.

Other autotransporters, for which the structure is known, can be predicted or will be known, such that their beta stem and side domain structure can be determined, may also be used with the present invention. The autotransporter should have a beta stem, a side domain and optionally a cleavage system that is efficient for soluble secretion. An example includes the autotransporter Hap$_s$ from H. influenzae, which is not a member of the SPATE family. The structure of the passenger of Hap$_s$ has recently been published (Meng et al 2011 Aug. 12 The EMBO Journal, doi: 10.1038/emboj.2011.279. [Epub ahead of print]). The structure is very close to that of Hbp, having a beta-stem with four side domains (SD1-4).

Figure 11:
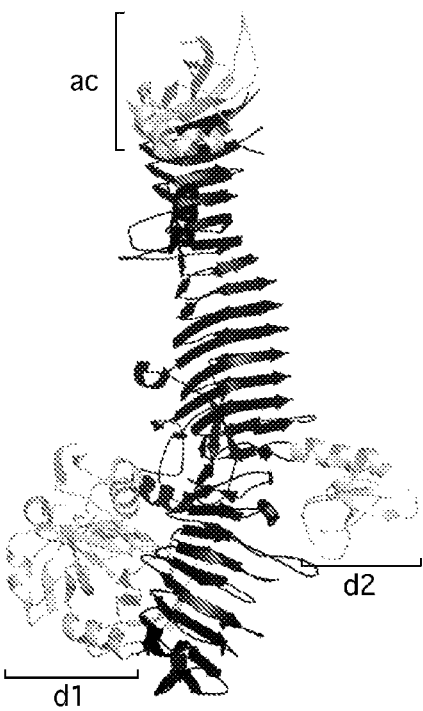
FIG. 11 A-D show figures of the structure of the passenger domain of Hbp where certain domains are indicated.
Figure 11:
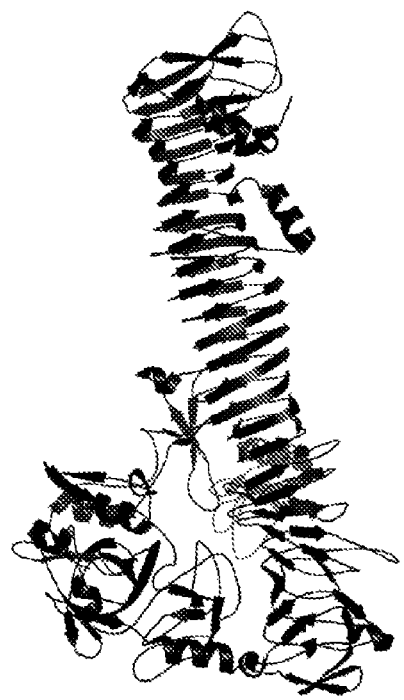
Figure 11:
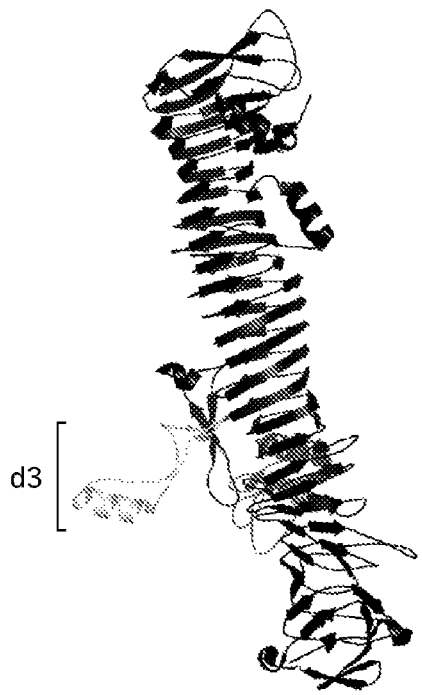
Figure 11:
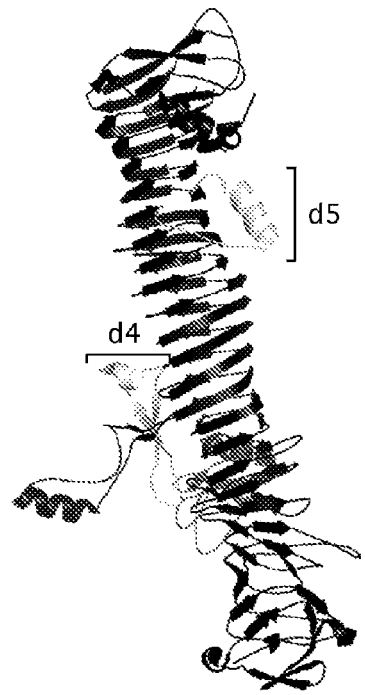
Figure 11:
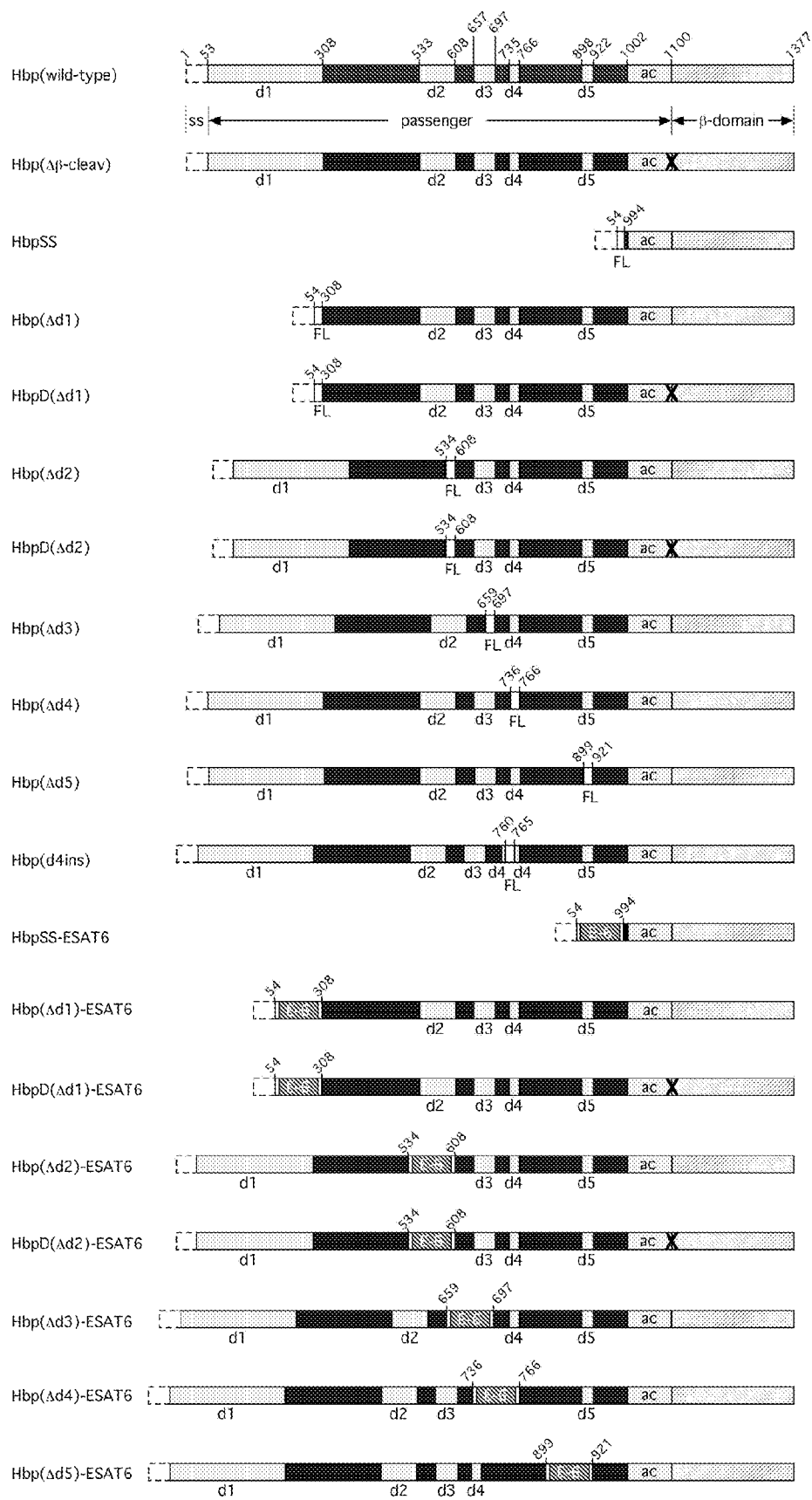
Figure 11:
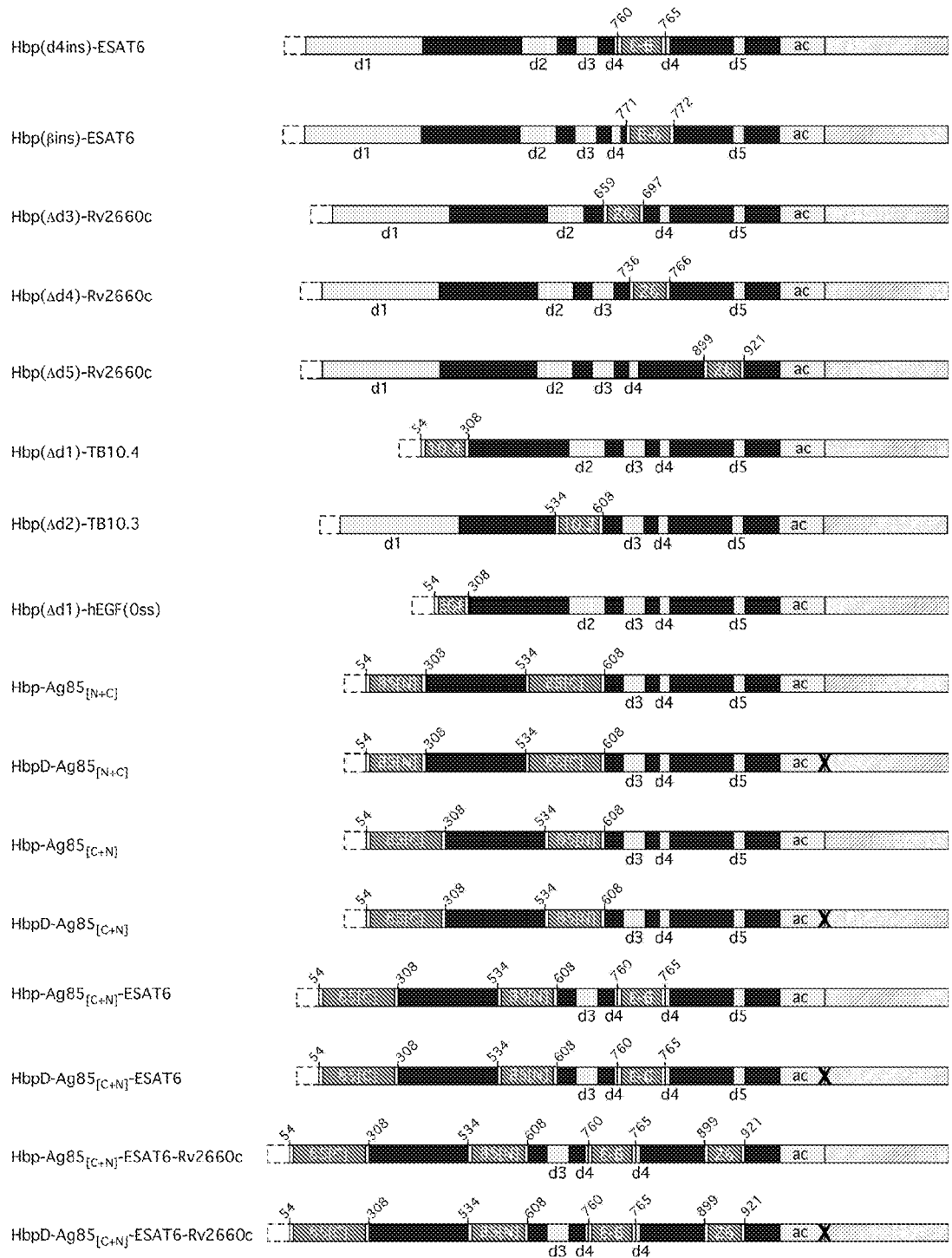
Figure 12:
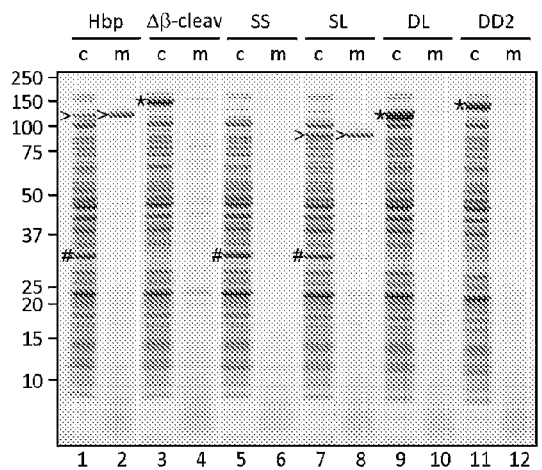
FIG. 12-33 show experimental data from examples 1-19. For details, see the example section.
Figure 12:
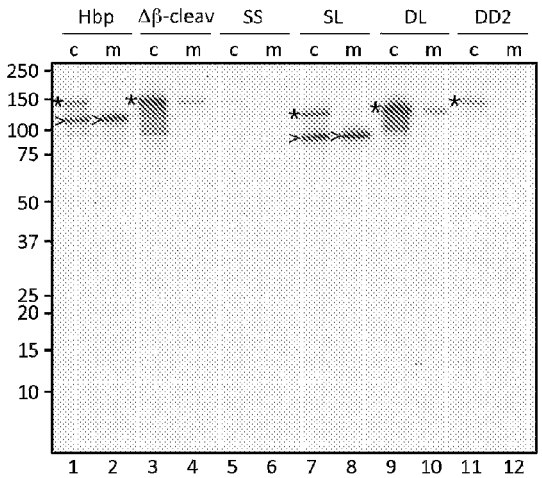
Figure 12:
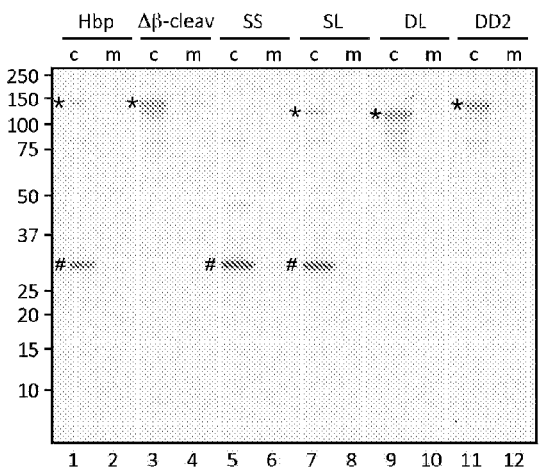
Figure 13:
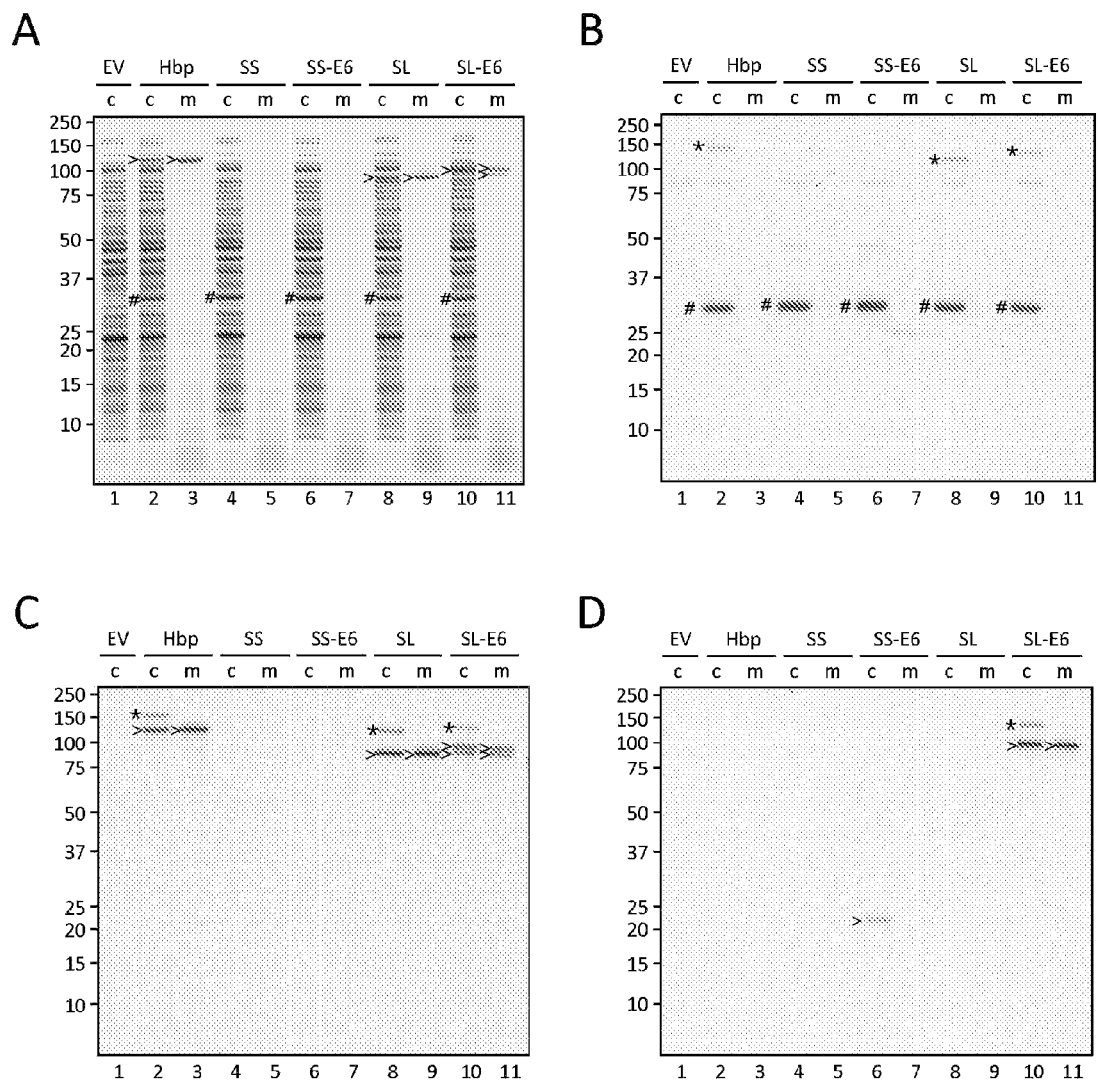

FIG. 11 A shows the crystal structure of the passenger domain of the autotransporter Hbp (Otto et al 2005 J Biol Chem 280(17): 17339-45). Domain 1 (d1), domain 2 (d2) and the autochaperone domain (ac) are in light grey. The remainder of the passenger domain, including the beta stem domain is colored black. Both domains d1 and d2 are suitable for insertion of a POI. In addition, the domain d3 shown in FIG. 11 C and domains d4 and d5 shown in FIG. 11D are suitable for replacement or insertion of a POI.

Domain d1 comprises approximately the amino acids 53 to 308, d2 comprises approximately the amino acids 533-608, d3 comprises approximately the amino acids 657-697, d4 comprises approximately the amino acids 735 to 766 and d5 comprises approximately amino acids 898 to 922 of SEQ ID NO 1, which is the sequence of Hbp.

FIG. 11 E shows the domain composition of wild-type Hbp. In addition, fusion proteins used in the examples presented herein are shown. In wild-type Hbp, the passenger domain comprising the beta stem (in black) and the side domains d1, d2, d3, d4 and d5 is shown. The translocator domain is located at the C-terminal part of the protein and is indicated as "β-domain". "Ac" indicates an autochaperone domain. The signal peptide is denoted by "ss". Numbers indicate amino acid number from the N-terminus.

A passenger domain that comprises approximately amino acids 53-1100 of SEQ ID NO 1, or a similar sequence, can be used.

A translocator domain that comprises approximately amino acids 1101-1377 of SEQ ID NO1, or a similar sequence, can be used.

The POI can be a split protein. A split protein is a protein which in its native form comprises a single polypeptide or several polypeptides that are linked by disulphide bridges or other intermolecular bonds, and which for the present invention has been split in two or more parts. Each such part is fused to the passenger such that they form a non-native structure, for example at a distance apart. The two or more parts may for instance be fused to different side domains or to the same side domain but at a distance apart. Each such part is considered to be one POI, such that the split protein is considered to be two or more POI:s. This could for example be advantageous when the native protein has a large or complex structure, for example comprising disulphide bridges, that inhibits efficient secretion. Splitting the protein may make the secretion more efficient.

The POI can comprise at least one antigen, for example from an infectious organism such as Mycobacterium tuberculosis. Examples of such antigens from Mycobacterium tubercolosis include ESAT-6-like proteins (e.g. ESAT-6, TB10.4, TB10.3), an Ag85B-like protein (e.g. Ag85B), and Rv 2660c. Two or more of such antigens may be fused to the same passenger, for example to separate side domains.

ESAT-6 (early secretory antigenic target of 6 kDa) is a 10 kDa protein that is a potent T-cell antigen and an important virulence factor.

Rv2660c is a 7.6 kDa intracellular protein of unknown function.

TB10.3 and TB10.4 are both 96 amino acid proteins.

Ag85B is a secretory mycolyltransferase of 35 kDa, comprising three cysteines. It is also a potent T-cell antigen. This rather large and cysteine comprising protein is too complex, in its native form, for optimal outer membrane translocation using the autotransporter system.

In one embodiment the antigen is split as defined above. For example, Ag85B, which is a large and rather complex protein, may be split into a N'-part (Ag85B(N')) and a C'-part (Ag85B(C')) for more efficient secretion.

In one embodiment the POI comprises a polypeptide with a sequence that is at least 80%, more preferably 90%, more preferably 95% most preferably 97% similar to SEQ ID NO 39, which is the sequence of ESAT-6. In one embodiment the POI comprises the polypeptide defined in SEQ ID NO 39.

In one embodiment the POI comprises a polypeptide with a sequence that is at least 80%, more preferably 90%, more preferably 95% most preferably 97% similar to SEQ ID NO 41, which is the sequence of Rv2660c. In one embodiment the POI comprises the polypeptide defined in SEQ ID NO 41.

In one embodiment the POI comprises a polypeptide with a sequence that is at least 80%, more preferably 90%, more preferably 95% most preferably 97% similar to SEQ ID NO 42, which is the sequence of TB10.4. In one embodiment the POI comprises the polypeptide defined in SEQ ID NO 42.

In one embodiment the POI comprises a polypeptide with a sequence that is at least 80%, more preferably 90%, more preferably 95% most preferably 97% similar to SEQ ID NO 43, which is the sequence of TB10.3. In one embodiment the POI comprises the polypeptide defined in SEQ ID NO 43.

In one embodiment the POI comprises a polypeptide with a sequence that is at least 80%, more preferably 90%, more preferably 95% most preferably 97% similar to at least ¼ of SEQ ID NO 40, which is the sequence of Ag85B. In one embodiment the POI comprises the polypeptide defined by amino acids 1-126 or 118-285 in SEQ ID NO 40.

The POI can be flanked by one or more linker regions. A linker region can be a flexible peptide of 1 to 20, or more, amino acids. The linker region can suitably be inserted at the C- and N-termini of the POI. An advantage of a linker is that it may allow the various domains of the fusion protein to move more independent of each other. A linker can easily be designed by a person skilled in the art. Examples of suitable linkers include SEQ ID NO 44 and 45.

The fusion protein can comprise the polypeptide defined in any of SEQ ID NO:s 13-19, SEQ ID NO:s 22-26 or SEQ ID NO 38 or a polypeptide which is at least 80%, more preferably 90%, more preferably 95% and most preferably 97% similar to any one of those sequences.

SEQ ID NO 13 is the sequence of Hbp were ESAT6 has replaced domain d1 (Hbp(Δd1)-ESAT6, also named HbpSL-ESAT6). SEQ ID NO 14 is the same protein but where the cleavage site between the translocator domain and the passenger domain has been disrupted (HbpD(Δd1)-ESAT6, also named HbpDL-ESAT6). SEQ ID NO 15 is the sequence of Hbp where ESAT6 has replaced domain d2 (Hbp(Δd2)-ESAT6). SEQ ID NO 16 is the sequence of Hbp where ESAT6 has replaced domain d2 (HbpD(Δd2)-ESAT6, also named HbpDD2-ESAT6) and where the cleavage site between the translocator domain and the passenger domain has been disrupted. SEQ ID NO 17 is the sequence of Hbp where ESAT6 has replaced domain d3 (Hbp(Δd3)-ESAT6). SEQ ID NO 18 is the sequence of Hbp where ESAT6 has replaced domain d4 (Hbp(Δd4)-ESAT6). SEQ ID NO 19 is the sequence of Hbp where ESAT6 has replaced domain d5 (Hbp(Δd5)-ESAT6).

SEQ ID NO 22 is the sequence of Hbp where Rv2660c has replaced domain d3 (Hbp(Δd3)-Rv2660c). SEQ ID NO 23 is the sequence of Hbp where Rv2660c has replaced domain d4 (Hbp(Δd4)-Rv2660c). SEQ ID NO 24 is the sequence of Hbp where Rv2660c has replaced domain d5 (Hbp(Δd5)-Rv2660c). SEQ ID NO 25 is the sequence of Hbp where TB10.4 has replaced domain d1 (Hbp(Δd1)-TB10.4). SEQ ID NO 26 is the sequence of Hbp where TB10.3 has replaced domain d2 (Hbp(Δd2)-TB10.3).

SEQ ID NO 38 is the sequence of EspC where ESAT6 has replaced domain d1 (EspC(Δd1)-ESAT6).

The fusion protein can comprise a polypeptide with more than one POI, such as the polypeptide defined in any of SEQ ID NO:s 28-35 or a polypeptide which is at least 80%, more preferably 90%, more preferably 95% and most preferably 97% similar to any one of those sequences.

SEQ ID NO 28 is the sequence of Hbp where residues 1-126 of Ag85B has replaced domain d1 and residues 118-285 of Ag85B has replaced domain 2 (Hbp-Ag85B$_{[N+C]}$).

SEQ ID NO 29 is the sequence of Hbp where residues 1-126 of Ag85B has replaced domain d1 and residues 118-285 of Ag85B has replaced domain 2, and where the cleavage site between the translocator domain and the passenger domain has been disrupted (HbpD-Ag85B$_{[N+C]}$). SEQ ID NO 30 is the sequence of Hbp where residues 1-126 of Ag85B has replaced domain d2 and residues 118-285 of Ag85B has replaced domain 1 (Hbp-Ag85B$_{[C+N]}$). SEQ ID NO 31 is the sequence of Hbp where residues 1-126 of Ag85B has replaced domain d2 and residues 118-285 of Ag85B has replaced domain 1, and where the cleavage site between the translocator domain and the passenger domain has been disrupted (HbpD-Ag85B$_{[C+N]}$).

SEQ ID NO 32 is the sequence of Hbp where residues 1-126 of Ag85B has replaced domain d2, residues 118-285 of Ag85B has replaced domain 1 and ESAT6 has replaced domain d4 (Hbp-Ag85B$_{[C+N]}$-ESAT6). SEQ ID NO 33 is the same protein but where the cleavage site between the translocator domain and the passenger domain has been disrupted (HbpD-Ag85B$_{[C+N]}$-ESAT6). SEQ ID NO 34 is the sequence of Hbp where residues 1-126 of Ag85B has replaced domain d2, residues 118-285 of Ag85B has replaced domain 1, ESAT6 has replaced domain d4 and Rv2660c has replaced domain 5 (Hbp-Ag85B$_{[C+N]}$-ESAT6-Rv2660c). SEQ ID NO 35 is the same protein but where the cleavage site between the translocator domain and the passenger domain has been disrupted (HbpD-Ag85B$_{[C+N]}$-ESAT6-Rv2660c).

Preferably, the order of domains of the fusion protein is, from the N-terminus to the C-terminus: signal peptide, passenger domain, translocator domain.

In a second aspect of the invention it is provided a cell expressing a fusion protein as defined herein. The cell is preferably a host cell that can be cultured and manipulated by methods well known to a person skilled in the art and which is able to express heterologous proteins. Preferably the host cell is a Gram-negative bacterium such as *E. coli*, *Salmonella* spp., *Vibrio* spp., *Shigella* spp., *Pseudomonads* spp., *Burkholderia* spp. or *Bordetella* spp. A wide variety of expression systems are available and known to a person skilled in the art. The expression may be of a stable or transient nature. The expression system may be inducible or non-inducible.

In one embodiment the fusion protein is at least partly solubly secreted by the host cell. This embodiment can be used when the invention is used for production of a recombinant protein, which is, for example, a commercial enzyme or a component of a pharmaceutical. The POI can then be conveniently harvested from the media, without breaking up the host cells. Breaking up the host cells causes contamination with cellular debris and cellular content. Secretion of the fusion protein can be achieved when the fusion protein comprises a protease cleavage site between the translocator domain and the passenger domain. A protease activity, which may reside in the fusion protein itself, cleaves the fusion protein when the translocator domain has integrated into the outer membrane so that the passenger domain is released into the medium. Alternatively, cleavage may take place via an intramolecular autocatalytic cleavage mechanism that is unrelated to protease activity as described for the SPATE EspP from *E. coli* (Dautin et al 2007 EMBO J. 26(7): 1942-1952) and AIDA-I from *E. coli* (Charbonneau et al 2009 J Biol Chem 284(25): 17340-17353).

For the sake of clearness, the POI may in some cases remain attached to the cell membrane even though the polypeptide has been cleaved. Such attachment will usually be of a non-covalent nature.

In one embodiment the POI remains covalently attached to the translocator domain. Where the sequence of the autotransporter harbors a cleavage site, this can be achieved by mutating the cleavage site between the translocator domain and the passenger domain, so that the cleavage event does not take place. Thus, the host cell displays at least a part of the fusion protein comprising at least one POI on the cell surface.

In certain aspects the invention provides outer membrane vesicles (OMV:s) or bacterial ghosts displaying a fusion protein according to the invention on their surface.

Under certain conditions Gram negative bacteria may be induced to start shedding vesicles from their outer membrane. Such outer membrane vesicles (OMV:s) have for example been shown to be useful as vaccine platforms. When carrying antigens, as derived from their mother cells, these vesicles are capable of enhancing the immunogenicity of such antigen. OMV:s may easily be derived from gram negative bacteria displaying the fusion protein of the invention on their surface. Methods for outer membrane vesicle production and isolation are known in the art (Chen et al 2010 PNAS 107:3099-3104; Bernadac et al 1998 J Bacteriol 180: 4872-4878; Kesty and Kuehn 2004 J Biol Chem 279: 2069-2076); Kolling and Matthews 1999 App Env Microbiol 65: 1843-1848; Kitagawa et al 2010 J Bacteriol 192: 5645-5656).

Similarly, bacterial ghosts are a nonliving vaccine platform. Bacterial ghosts are bacterial cell envelopes that have been emptied of their cytoplasm by means of lysis, for example using the lethal lysis gene E from bacteriophage PhiX174 (Langemann et al 2010 Bioeng Bugs 1:326-336; Young 1992 Microbiol rev 56: 430-481; Mayr et al 2005 Adv Drug Deliv rev 57: 1381-1391). They retain all morphological, structural and antigenic features of the mother cell and comprise proteins that are expressed and anchored to the cell envelope before lysis. Delivery of for example antigenic proteins can be facilitated by the secretion system and the fusion proteins of the invention.

One aspect of the invention is a vaccine comprising a fusion protein, a cell, an outer membrane vesicle or a bacterial ghost according to the invention. The vaccine can comprise a host cell that displays a fusion protein comprising at least one POI at the cell surface. Preferably the POI is then an antigen as described above. The host cell can be an attenuated *Salmonella* strain, such as the strains described in Curtiss R 3$^{rd}$ et al 2010 Crit Rev Immunol 30(3): 255-70. The vaccine can comprise living host *Salmonella* cells.

One aspect of the invention is a nucleic acid which encodes a fusion protein according to the invention as has been described above. One further aspect of the invention is a vector carrying a nucleic acid according to the invention.

The nucleic acid or vector may be arranged for expression of more than one POI fused to the same passenger domain. For example, the sequence which encodes the passenger domain can comprise at least two stretches of cloning site sequence that allow in-frame cloning of at least two POI encoding sequences. This facilitates easy cloning and expression of any desired POI:s. Alternatively the nucleic acid may comprise more than one sequence encoding POI:s, fused to the passenger domain.

One aspect of the invention comprises a method for secretory protein expression of a POI comprising the step of expressing a fusion protein according to the invention in a host cell. Expression vectors are well known to a person skilled in the art. Suitably, the vector has a promoter suitable for the host cell which is operatively linked to the nucleic acid that encodes the fusion protein according to the invention.

The method can comprise the step of identifying suitable side domains on an autotransporter protein. This can be carried out with the biophysical methods or the bioinformatics methods described above.

One aspect of the method according to the invention comprises the step of replacing a side domain (or a part thereof) of a passenger domain of an autotransporter with a POI so that the beta-stem forming sequence of the passenger domain of the autotransporter is essentially intact. Alternatively, the method can comprise the step of inserting the POI into the passenger domain so that the beta stem forming sequence is essentially intact.

The method comprises the step of culturing the host cell under conditions wherein the nucleic acid encoding the fusion protein is translated to a multitude of fusion protein molecules and the fusion protein molecule enters the secretory pathway.

In one embodiment, the method comprises the additional step of inhibiting a periplasmic enzyme with protease activity in the host cell, such as DegP. The protease activity of DegP can be inhibited by deleting, interrupting or inactivating the DegP-encoding gene on the chromosome of the host cell. Inactivation can be carried out by the introduction of a mutation in the catalytic site of DegP. The inhibition of a protease has the advantage that yield can be improved.

In one embodiment the method comprises the additional step of down regulation of at least one enzyme, such as DsbA or DsbB, that catalyses the formation of disulphide bonds in proteins in the periplasmic space of the host cell. This has the advantage that yield can be improved, especially for proteins that are prone to form disulphide bridges, such as proteins of eukaryotic origin.

In one embodiment of the method the POI is soluble secreted. In one embodiment of the method the POI remains covalently attached to the cell surface.

In one embodiment the method comprises the further step of inducing shedding of vesicles from the outer membrane of the host cell, to produce outer membrane vesicles displaying the fusion protein of the invention on their surface.

In another embodiment the method comprises the additional step of lysing the gram negative bacterium, for example using the lethal lysis gene E from bacteriophage PhiX174, thus forming bacterial ghosts displaying the fusion protein on their surface.

One final aspect of the invention comprises a fusion protein obtainable according to the method of the invention.

EXAMPLES

Methods
Strains and Media

*E. coli* strain MC1061 (araD139 Δ(araA-leu)7697 ΔlacX74 galK16 galE15(GalS) λ$^-$ e14$^-$ mcrA0 relA1 rpsL150(strR) spoT1 mcrB1 hsdR2) has been described previously (Casadaban and Cohen 1980 J Mol Biol 138: 179-207). Strain TOP10F' was obtained from Invitrogen.

Cells were routinely grown at 37° C. in LB medium supplemented with 0.2% glucose. Overnight cultures were grown in the presence of 0.4% glucose. Cells were grown in the presence of chloroamphenicol (30 μg/ml) and streptomycin (25 μg/ml) or Tetracycline (6.25 μg/ml), where appropriate.

Construction of Plasmids

Plasmid pEH3-Hbp (FIG. 1) carries the full-length hbp gene, the expression of which is under control of an inducible LacUV5 promoter. The construction of this plasmid has been described in (Jong et al 2007 Mol Microbiol 63(5): 1524-1536).

In FIGS. 1-10 the translocator domain is referred to as "β-domain".

TABLE 1

Primers used in this study

| Name | SEQ ID NO | Sequence (5' à 3') |
|---|---|---|
| Hbp944-962 fw | 86 | gaacatcggaaggtggtgc |
| Hbp1123-1104 rv | 87 | gagaaaccgaatccttaagg |
| Hbp2154-2137 rv | 88 | ggatggttgtgttcagtgtg |
| pEH_XbaI_Hbp fw | 89 | taactttctagattacaaaacttaggagggttttaccatgaacagaatttattctcttcg |
| EcoRI_Hbp rv | 90 | cagtgaattctcagaatgaataacgaatattag |
| Hbp(Δdom1/Cas) fw | 91 | gggagctcctgcggatccggcagcggtaatgatgccccggtcacgttc |
| Hbp(Δdom1/Cas) rv | 92 | cggatccgcaggagctccccgcaagacttcctgcagag |
| Hbp(Δdom2/Cas) fw | 93 | ctgggagctccgcaggatccggcagcggtaatactgcagggtatctgtttc |
| Hbp(Δdom2/Cas) rv | 94 | ctgccggatcctgcggagctcccagaaccggcatagtccagcgtgatag |
| Hbp(Δβ-stem/Cas) fw | 95 | gggagctcctgcggatccggcagcggtgcagacaaactggtgataaac |
| Hbp 2838-2820 rv | 96 | gttcatcgaccactgggtg |
| Hbp(Δdom3/Cas) fw | 97 | gggagcggagctccgcaggatccggcagcggtaaccgcagttttacctttgac |
| Hbp(Δdom3/Cas) rv | 98 | accgctgccggatcctgcggagctcccgctcccctgcagcgtcagacg |
| Hbp 1859-1879 fw | 99 | gcaatctgaatgtggacaatc |
| Hbp(Δdom4/Cas) fw | 100 | Gggagcggagctccgcaggatccggcagcggtagtgtcttcaacggcaccg |
| Hbp(Δdom4/Cas) rv | 101 | accgctgccggatcctgcggagctcccgctcccgtcgcccagcgtgacgctg |
| Hbp(Δdom5/Cas) fw | 102 | GggagcggagctccgcaggatccggcagcgGGTACCgcaatatctggagc |
| Hbp(Δdom5/Cas) rv | 103 | gctgccggatcctgcggagctcccgctccctccgagggtgacagtc |
| Hbp 3003-3021 rv | 104 | gtcatgacctgttgccgac |
| Hbp(d4ins/Cas) fw | 105 | ctgggagctccgcaggatccggcagcggtaaaagtgtcttcaacggcacc |
| Hbp(d4ins/Cas) rv | 106 | ctgccggatcctgcggagctcccagaacctgcaacagatgtgccttcttc |
| Hbp((βins/Cas) fw | 107 | Gggagcggagctccgcaggatccggcagcggtaccgtcaacctggataatcagt |
| Hbp((βins/Cas) rv | 108 | accgctgccggatcctgcggagctcccgctcccgccgttgaagacacttttatctg |
| Cas/Rv2660c fw | 109 | cggggagctccgtgatagcgggcgtcgacc |
| Cas/Rv2660c rv | 110 | tgccggatccgtgaaactggttcaatcccag |
| Cas/TB10.4 fw | 111 | cggggagctccatgtcgcaaatcatgtacaac |
| Cas/TB10.4 rv | 112 | tgccggatccgccgccccatttggcgg |
| Cas/Ag85B fw | 113 | cggggagctccttctcccggccggggc |
| Cas/Ag85B rv | 114 | tgccggatccgccggcgcctaacgaac |
| Cas/Ag85B(T118) fw | 115 | cggggagctccaccggcagcgctgcaatcg |
| Cas/Ag85B(S126) rv | 116 | tgccggatcccgacaagccgattgcagcg |
| pEH_XbaI_EspC_fw | 117 | taactttctagattacaaaacttaggagggttttaccatgaataaaatatacgcattaaaata |
| EcoRI_EspC rv | 118 | Gtcagaattctcagaaagaataacggaagttag |
| EspC(Δdom1/Cas) fw | 119 | gggagctccgcaggatccggcagcggtttaaaaaacaaatttactcaaaaagtc |
| EspC(Δdom1/Cas) rv | 120 | cggatcctgcggagctcccagcctgagatgcgcttaaaaaag |
| EspC (BglII) rv | 121 | Ccagagccaatgtttacgtc |

TABLE 1-continued

Primers used in this study

| Name | SEQ ID NO | Sequence (5' à 3') |
|---|---|---|
| p15a fw | 122 | gtacgaattcgtgcgtaacggcaaaagcac |
| p15a rv | 123 | gtacgtcgacacatgagcagatcctctacg |

Plasmid pEH3-Hbp[Δβ-cleav] (FIG. 2) is a pEH3-Hbp (Jong et al, 2007) derivative that carries an hbp mutant that encodes a version of Hbp in which the natural cleavage site between the passenger domain and the translocator domain has been disrupted upon substitution of amino acid residues $Asn^{1100}$ and $Asn^{1101}$ by a Gly and Ser residue, respectively. The construction of pEH3-Hbp[Δβ-cleav] has been described in (Jong et al 2007 Mol Microbiol 63(5): 1524-1536).

Plasmid pHbpD(Δd1), which is the same as pHbpDL, (FIG. 3) is a pEH3-Hbp[Δβ-cleav] (Jong et al 2007 Mol Microbiol 63(5): 1524-1536) derivative that carries an hbp mutant that encodes a truncated version of Hbp[Δβ-cleav] (Jong et al 2007 Mol Microbiol 63(5): 1524-1536) in which amino acid residues 54-307 of the full-length Hbp amino acid sequence have been replaced by the amino acid sequence Ser-Ser-Cys-Gly-Ser-Gly-Ser-Gly (SEQ ID NO 45). The DNA sequence that encodes the latter amino acid sequence contains SacI and BamHI restriction sites that allow easy in-frame cloning of DNA sequences that encode heterologous amino acid sequences into the HbpD(Δd1) coding sequence. To create pHbpD(Δd1), first, a variant of pEH3-Hbp[Δβ-cleav] (pEH3-Hbp[Δβ-cleav/ΔBamHI]) was created lacking BamHI restriction sites inside and outside of the Hbp[Δβ-cleav] coding region, respectively. Subsequently, a three-step 'overlapping extension PCR' procedure was carried out. In the first step a DNA fragment was amplified by PCR using pEH3-Hbp (Jong et al 2007 Mol Microbiol 63(5): 1524-1536) as a template and the primers pEH_XbaI_Hbp fw and Hbp(Δdom1/Cas) rv. In the second step a DNA fragment was amplified by PCR using pEH3-Hbp (Jong et al 2007 Mol Microbiol 63(5): 1524-1536) as a template and the primers Hbp(Δdom1/Cas) fw and Hbp1123-1104 rv. In the third step a DNA fragment was amplified using a mixture of the PCR products from step 1 and 2 as template and the primers pEH_XbaI_Hbp fw and Hbp1123-1104 rv. The PCR product from step three was cloned into pEH3-Hbp[Δβ-cleav/ΔBamHI] using the XbaI and NdeI restriction sites, yielding plasmid pHbpD(Δd1).

For primers used in this study see Table 1.

Plasmid pHbpD(Δd2), which is the same as pHbpDD2, (FIG. 5) was created according to the same general procedure as pHbpD(Δd1), but with the following modifications: Amino acid residues 534-607 of the full-length Hbp amino acid sequence was replaced by the amino acid sequence Gly-Ser-Gly-Ser-Ser-Ala-Gly-Ser-Gly-Ser-Gly (SEQ ID NO 44). The DNA sequence that encodes the amino acid sequence also contains SacI and BamHI restriction sites for easy in-frame cloning of DNA sequences that encode heterologous amino acid sequences. For the first PCR amplification step primers Hbp944-962 fw and Hbp(Δdom2/Cas) rv were used. For the second PCR amplification step primers Hbp(Δdom2/Cas) fw and Hbp 2154-2137 rv were used. And for the third step primers Hbp944-962 fw and Hbp2154-2137 rv were used.

The PCR product from step three was cloned into pEH3-Hbp [Δβ-cleav/ΔBamHI] using NdeI and NsiI restriction sites.

Plasmid pHbp(Δd1), which is the same as pHbpSL, (FIG. 7) is a pEH3-Hbp (Jong et al 2007 Mol Microbiol 63(5): 1524-1536) derivative that carries an hbp mutant that encodes a truncated version of Hbp [pHbp(Δd1)] in which amino acid residues 54-307 of the full-length Hbp amino acid sequence have been replaced by the amino acid sequence Ser-Ser-Cys-Gly-Ser-Gly-Ser-Gly (SEQ ID NO 45). The DNA sequence that encodes the latter amino acid sequence contains SacI and BamHI restriction sites that allow easy in-frame cloning of DNA sequences that encode heterologous amino acid sequences into the Hbp(Δd1) coding sequence. To construct pHbp(Δd1), first a variant of pEH3-Hbp (pEH3-Hbp/ΔBamHI) was created lacking a BamHI site downstream of the hbp ORF. Subsequently, a three-step 'overlapping extension PCR' procedure was carried out. In the first step a DNA fragment was amplified by PCR using pEH3-Hbp (Jong et al 2007 Mol Microbiol 63(5): 1524-1536) as a template and the primers pEH_XbaI_Hbp fw and Hbp(Δdom1/Cas) rv. In the second step a DNA fragment was amplified by PCR using pEH3-Hbp (Jong et al 2007 Mol Microbiol 63(5): 1524-1536) as a template and the primers Hbp(Δdom1/Cas) fw and Hbp1123-1104 rv. In the third step a DNA fragment was amplified using a mixture of the PCR products from step 1 and 2 as template and the primers pEH_XbaI_Hbp fw and Hbp1123-1104 rv. The PCR product from step three was cloned into pEH3-Hbp[ΔBamHI], a derivative of pEH3-Hbp lacking a BamHI restriction site downstream of the hbp gene, using the XbaI and NdeI restriction sites, yielding plasmid pHbp(Δd1).

Plasmids pHbpSS (FIG. 9), pHbp(Δd2), pHbp(Δd3), pHbp (Δd4), pHbp(Δd5), pHbp(d4ins) and pHbp(βins) were created according to the same general procedure as pHbpD (Δd1), but with the following modifications:

For pHbpSS: Amino acid residues 54-993 of the full-length Hbp amino acid sequence were replaced by the amino acid sequence Ser-Ser-Cys-Gly-Ser-Gly-Ser-Gly (SEQ ID NO 45). For the first PCR amplification step primers pEH_XbaI_Hbp fw and Hbp(Δdom1/Cas) rv were used. For the second PCR amplification step primers Hbp(Δβ-stem/Cas) fw and EcoRI_Hbp rv were used. And for the third step primers pEH_XbaI_Hbp fw and EcoRI_Hbp rv were used. The PCR product from step three was cloned into pEH3-Hbp [ΔBamHI] using the XbaI and NdeI restriction sites, yielding plasmid pHbpSS.

For pHbp(Δd2): Amino acid residues 534-607 of the full-length Hbp amino acid sequence were replaced by the amino acid sequence Gly-Ser-Gly-Ser-Ser-Ala-Gly-Ser-Gly-Ser-Gly (SEQ ID NO 44), the corresponding DNA sequence of which contains SacI and BamHI restriction sites for easy in-frame cloning of DNA sequences. For the first PCR amplification step primers Hbp944-962 fw and Hbp(Δdom2/Cas) rv were used. For the second PCR amplification step primers Hbp(Δdom2/Cas) fw and Hbp 2154-2137 rv were used. And for the third step primers Hbp944-962 fw and Hbp2154-2137 rv were used. The PCR product from step three was cloned into pEH3-Hbp[ΔBamHI] using the NdeI and NsiI restriction sites, yielding plasmid pHbp(Δd2).

For pHbp(Δd3): Amino acid residues 659-696 of the full-length Hbp amino acid sequence were replaced by the amino acid sequence Gly-Ser-Gly-Ser-Ser-Ala-Gly-Ser-Gly-Ser-Gly (SEQ ID NO 44). For the first PCR amplification step primers Hbp944-962 fw and Hbp(Δdom3/Cas) rv were used. For the second PCR amplification step primers Hbp(Δdom3/Cas) fw and Hbp 2838-2820 rv were used. And for the third step primers Hbp944-962 fw and Hbp 2838-2820 rv were used. The PCR product from step three was cloned into pEH3-Hbp[ΔBamHI] using the NdeI and KpnI restriction sites, yielding plasmid pHbp(Δd3).

For pHbp(Δd4): Amino acid residues 736-765 of the full-length Hbp amino acid sequence were replaced by the amino acid sequence Gly-Ser-Gly-Ser-Ser-Ala-Gly-Ser-Gly-Ser-Gly (SEQ ID NO 44). For the first PCR amplification step primers Hbp1859-1879 fw and Hbp(Δdom4/Cas) rv were used. For the second PCR amplification step primers Hbp(Δdom4/Cas) fw and Hbp 2838-2820 rv were used. And for the third step primers Hbp1859-1879 fw and Hbp2838-2820 rv were used. The PCR product from step three was cloned into pEH3-Hbp[ΔBamHI] using the NsiI and KpnI restriction sites, yielding plasmid pHbp(Δd4).

For pHbp(Δd5): Amino acid residues 899-920 of the full-length Hbp amino acid sequence were replaced by the amino acid sequence Gly-Ser-Gly-Ser-Ser-Ala-Gly-Ser-Gly-Ser-Gly (SEQ ID NO 44). For the first PCR amplification step primers Hbp1859-1879 fw and Hbp(Δdom5/Cas) rv were used. For the second PCR amplification step primers Hbp(Δdom5/Cas) fw and Hbp3003-3021 rv were used. And for the third step primers Hbp1859-1879 fw and Hbp3003-3021 rv were used. The PCR product from step three was cloned into pEH3-Hbp[ΔBamHI] using the NsiI and KpnI restriction sites, yielding plasmid pHbp(Δd5).

For pHbp(d4ins): Amino acid residues 760-764 of the full-length Hbp amino acid sequence were replaced by the amino acid sequence Gly-Ser-Gly-Ser-Ser-Ala-Gly-Ser-Gly-Ser-Gly (SEQ ID NO 44). For the first PCR amplification step primers Hbp1859-1879 fw and Hbp(d4ins/Cas) rv were used. For the second PCR amplification step primers Hbp(d4ins/Cas) fw and Hbp 2838-2820 rv were used. And for the third step primers Hbp1859-1879 fw and Hbp2838-2820 rv were used. The PCR product from step three was cloned into pEH3-Hbp[ΔBamHI] using the NsiI and KpnI restriction sites, yielding plasmid pHbp(d4ins).

For pHbp(βins): Amino acid sequence Gly-Ser-Gly-Ser-Ser-Ala-Gly-Ser-Gly-Ser-Gly (SEQ ID NO 44) was inserted between residues 771 and 772 of the full-length Hbp amino acid sequence. For the first PCR amplification step primers Hbp1859-1879 fw and Hbp(βins/Cas) rv were used. For the second PCR amplification step primers Hbp(βins/Cas) fw and Hbp 2838-2820 rv were used. And for the third step primers Hbp1859-1879 fw and Hbp2838-2820 rv were used. The PCR product from step three was cloned into pEH3-Hbp[ΔBamHI] using the NsiI and KpnI restriction sites, yielding plasmid pHbp(βins).

ESAT6 derivatives of the plasmids above were derived by a heterologous insertion corresponding to the *Mycobacterium tuberculosis* ESAT6 protein into the respective plasmids. To construct the ESAT6 derivatives a synthetic ESAT6-encoding DNA sequence was obtained from BaseClear B.V. (Leiden, The Netherlands), the codon-usage of which was optimized for expression in *E. coli*. The synthetic DNA fragment possessed SacI and BamHI sites at the 5' and 3' side of the ESAT6 coding sequence, respectively. This allowed cloning into the SacI and BamHI sites of pHbpD(Δd1), pHbpD(Δd2), pHbp(Δd1), pHbpSS, pHbp(Δd2), pHbp(Δd3), pHbp(Δd4), pHbp(Δd5), pHbp(d4ins) and pHbp(βins), yielding pHbpD(Δd1)-ESAT6, which is the same as pHbpDL-ESAT6 (FIG. 4), pHbpD(Δd2)-ESAT6, which is the same as pHbpDD2-ESAT6 (FIG. 6), pHbp(Δd1)-ESAT6, which is the same as pHbpSL-ESAT6 (FIG. 8), pHbpSS-ESAT6 (FIG. 10), pHbp(Δd2)-ESAT6, pHbp(Δd3)-ESAT6, pHbp(Δd4)-ESAT6, pHbp(Δd5)-ESAT6, pHbp(d4ins)-ESAT6 and pHbp(βins)-ESAT6, respectively.

Rv2660c derivatives of plasmids above were derived by a heterologous insertion corresponding to the *Mycobacterium tuberculosis* Rv2660c protein into the respective plasmids. To construct the Rv2660c derivatives the gene encoding Rv2660c with flanking SacI/BamHI sites was amplified by PCR using *M. tuberculosis* H37Rv genomic DNA as a template. The primers used were Cas/Rv2660c fw and Cas/Rv2660c rv. The PCR product was cloned into pHbp(Δd3), pHbp(Δd4) and pHbp(Δd5) using the SacI/BamHI sites, creating pHbp(Δd3)-Rv2660c, pHbp(Δd4)-Rv2660c and pHbp(Δd5)-Rv2660c, respectively.

TB10.3 and TB10.4 derivatives of plasmids above were derived by a heterologous insertion corresponding to the *Mycobacterium tuberculosis* proteins TB10.3 or TB10.4 into the respective plasmids. To construct TB10.3 and TB10.4 derivatives, the gene encoding TB10.3 or TB10.4 with flanking SacI/BamHI sites were amplified by PCR using *M. tuberculosis* H37Rv genomic DNA as a template. The primers used for TB10.3 were Cas/TB10.3 fw and Cas/TB10.3 rv. The PCR product was cloned into pHbp(Δd2) using the SacI/BamHI sites, creating pHbp(Δd2)-TB10.3. The primers used for TB10.4 were Cas/TB10.4 fw and Cas/TB10.4 rv. The PCR product was cloned into pHbp(Δd1) using the SacI/BamHI sites, creating pHbp(Δd1)-TB10.4.

Plasmid pHbp(Δd1)-hEGF(0ss) is a pHbp(Δd1) derivative expressing Hbp(Δd1) containing a heterologous insertion corresponding to a cysteineless version of the *Homo sapiens* hEGF protein. To construct pHbp(Δd1)-hEGF(0ss) a synthetic hEGF(0ss) encoding DNA sequence was obtained possessing SacI and BamHI sites at the 5' and 3' side of the hEGF(0ss) coding sequence, respectively, to allow cloning into the SacI and BamHI sites of pHbp(Δd1), yielding pHbp(Δd1)-hEGF(0ss).

Plasmid pHbp-Ag8513$_{(N+C)}$ is a pEH3-Hbp/ΔBamHI derivative expressing a mutant of Hbp in which an amino acid sequence corresponding to residues 1-126 of the mature region of the protein Ag85B from *Mycobacterium tuberculosis* (Ag85B$_{(N)}$) was inserted into a flexible linker that was located as described for pHbp(Δd1). In addition, an amino acid sequence corresponding to residues 118-285 of the mature region of the protein Ag85B (Ag8513$_{(C)}$) was inserted into a flexible linker that was located as described for pHbp(Δd2). To construct pHbp-Ag85B$_{(N+C)}$, fragments of fbpA encoding Ag85B$_{(N)}$ and Ag85B$_{(C)}$ were generated with flanking SacI/BamH sites using *M. tuberculosis* H37Rv genomic DNA as a template. For Ag85B$_{(N)}$, the primers used were Cas/Ag85B fw and Cas/Ag85B(S126) rv. The resulting PCR fragment was cloned into pHbp(Δd1) using the SacI/BamHI restriction sites, creating pHbp(Δd1)-Ag85B$_{(N)}$. For Ag85B$_{(C)}$ the primers used were Cas/Ag85B(T118) fw and Cas/Ag85B rv. The resulting PCR fragment was inserted into pHbp(Δd2) using the SacI/BamHI restriction sites, creating pHbp(Δd2)-Ag85B$_{(C)}$. Subsequently, the XbaI/NdeI fragment of pHbp(Δd2)-Ag85B$_{(C)}$ was substituted by the XbaI/NdeI fragment of pHbp(Δd1)-Ag85B$_{(N)}$, yielding pHbp-Ag85B$_{(N+C)}$.

Figure 23:
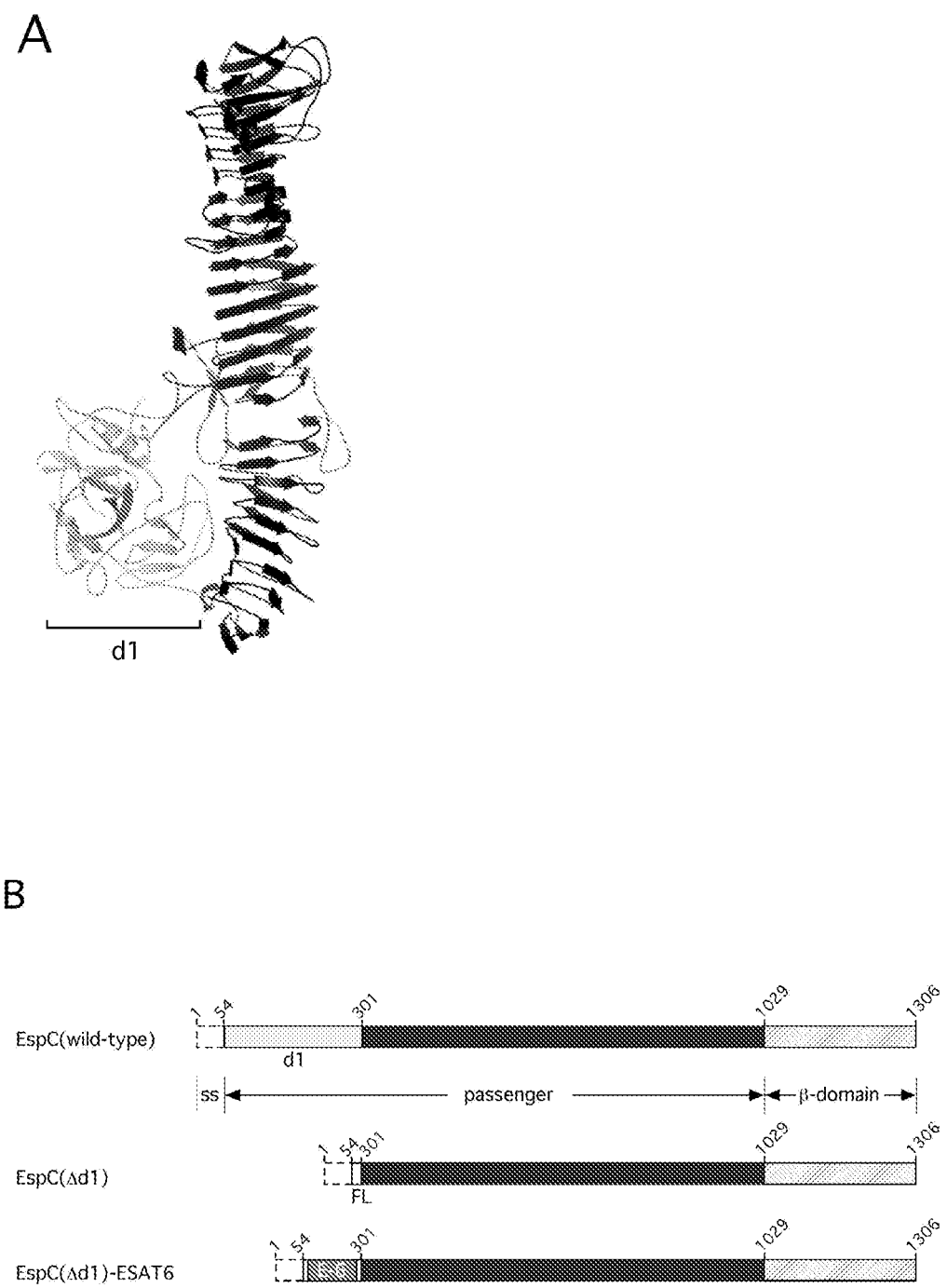
Figure 24:
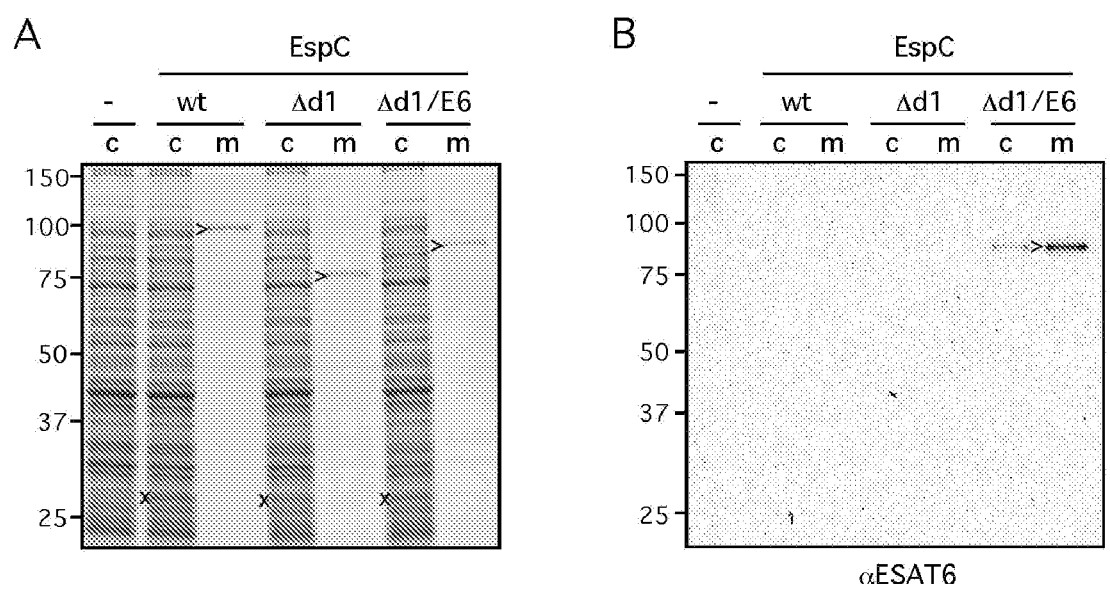
Figure 25:
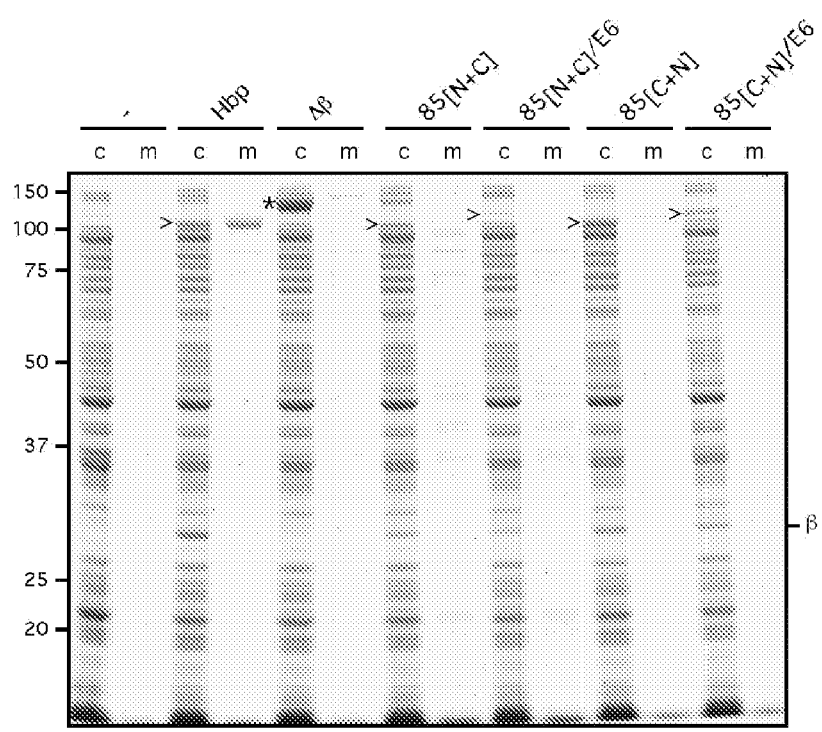
Figure 25:
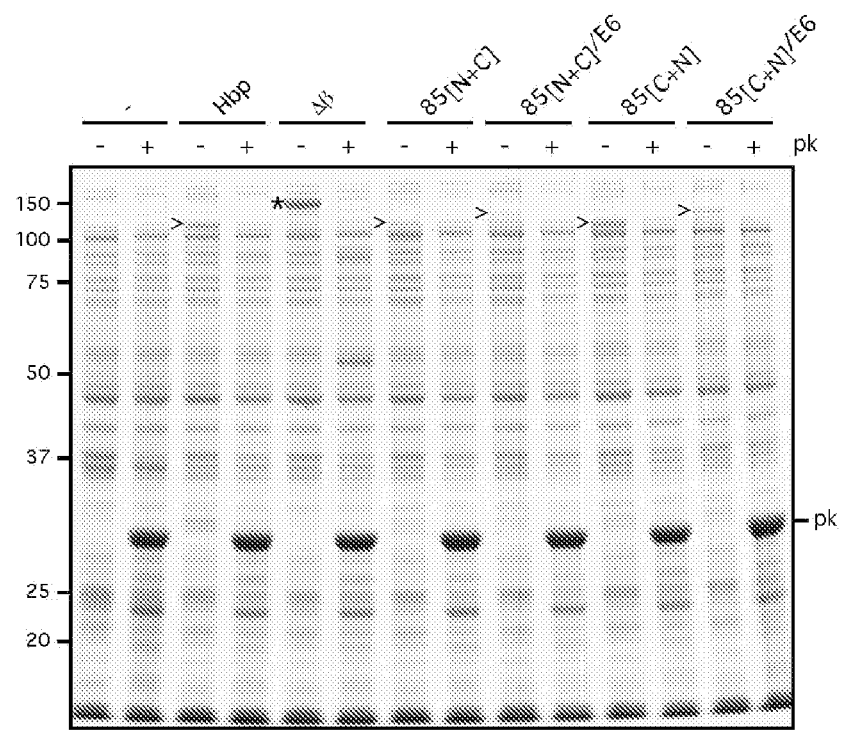
Figure 26:
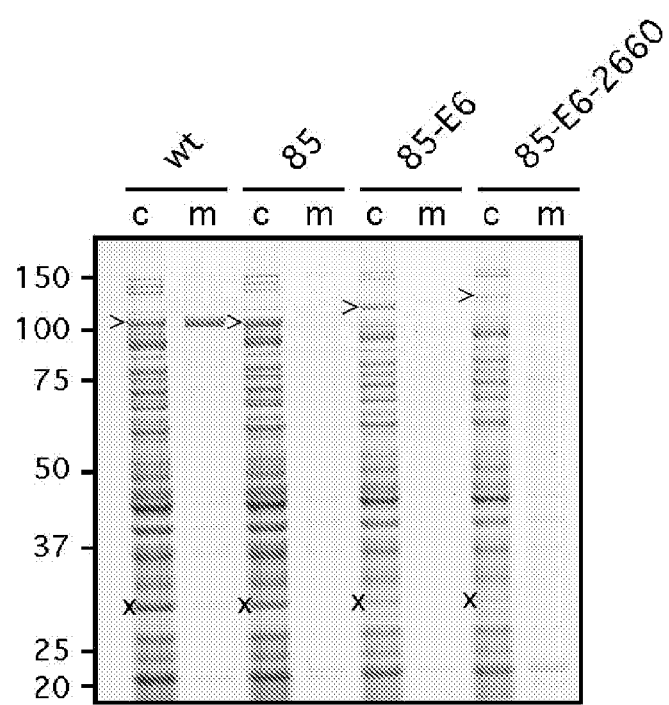
Figure 27:
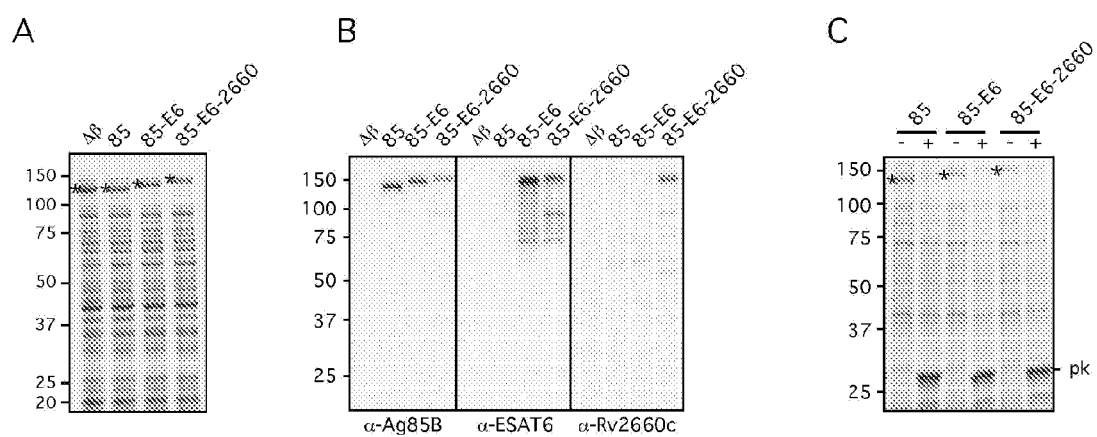
Figure 28:
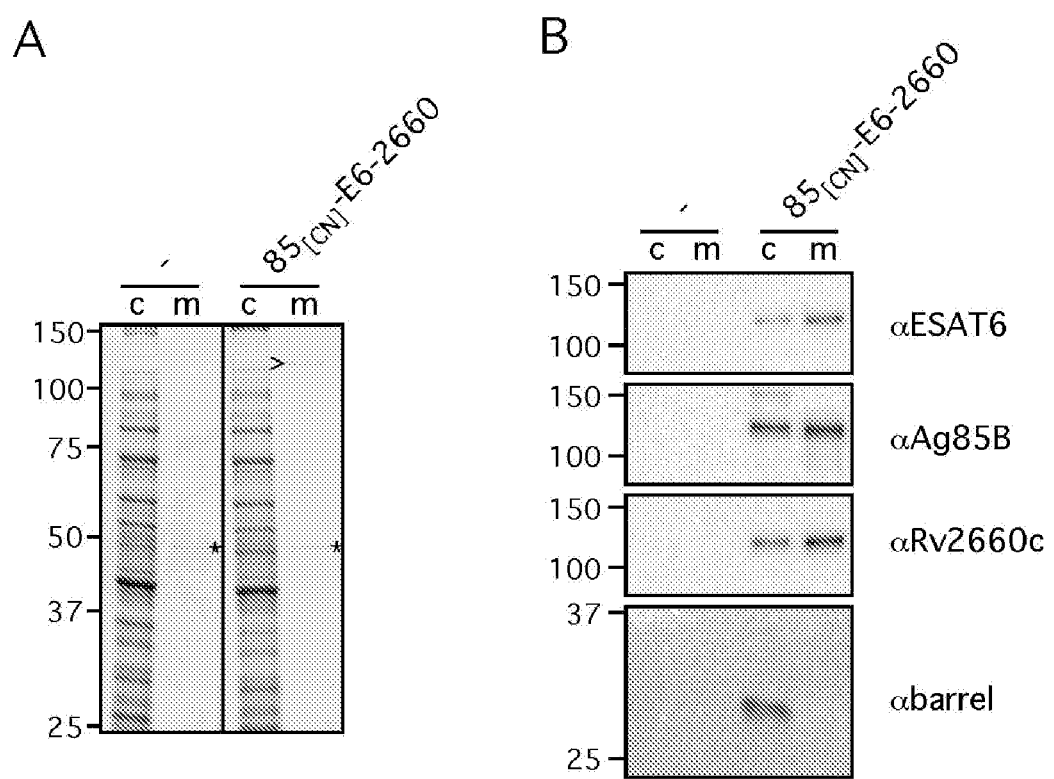
Figure 29:
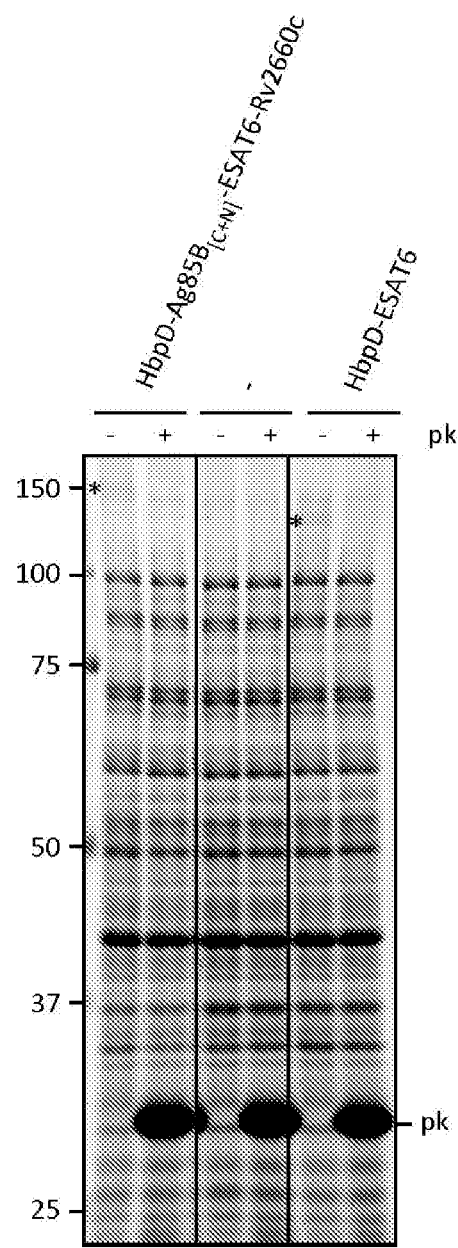

Plasmids pHbp-Ag85B$_{(C+N)}$, pHbpD-Ag85B$_{(N+C)}$ and pHbpD-Ag85B$_{(C+N)}$ were created according to the same general procedure as pHbp-Ag85B$_{(N+C)}$, but with the following modifications:

For pHbp-Ag85B$_{(C+N)}$ the N-terminal part (residues 1-126) of the mature region of the protein Ag85B from *Mycobacterium tuberculosis* (Ag85B$_{(N')}$) was inserted into a flexible linker that was located as described for pHbp(Δd2) and the C-terminal part (residues 118-285) was inserted into a flexible linker that was located as described for pHbp(Δd1). After PCR, using the same primers as above, the Ag85B$_{(N)}$ PCR product was cloned into pHbp(Δd2) using the SacI/BamHI restriction sites, and the Ag85B$_{(C)}$ PCR product was cloned into pHbp(Δd1) using the SacI/BamHI restriction sites, creating pHbp(Δd2)-Ag85B$_{(N)}$ and pHbp(Δd1)-Ag85B$_{(C)}$ respectively. Subsequently, the XbaI/NdeI fragment of pHbp(Δd2)-Ag85B$_{(N)}$ was substituted by the XbaI/NdeI fragment of pHbp(Δd1)-Ag85B$_{(C)}$, yielding pHbp-85B$_{(C+N)}$.

For pHbpD-Ag85B$_{(N+C)}$ and pHbpD-Ag85B$_{(C+N)}$ the same procedures as for pHbpD-Ag85B$_{(N+C)}$ and pHbpD-Ag85B$_{(C+N)}$ respectively were used, except that plasmids pHbpD(Δd1) and pHbpD(Δd2) were used instead of plasmids pHbp(Δd1) and pHbp(Δd2).

Plasmid pHbp-Ag85B$_{[C+N]}$-ESAT6 is derivative of pHbp-Ag85B$_{[C+N]}$ encoding a version of Hbp-Ag85B$_{[C+N]}$ in which an amino acid sequence corresponding to ESAT6 was inserted into a flexible linker that was located as described for pHbp(d4ins). To construct pHbp-Ag85B$_{[C+N]}$-ESAT6, the NsiI/KpnI fragment of pHbp-Ag85B$_{[C+N]}$ was substituted by that of pHbp(d4 in)-ESAT6, creating pHbp-Ag85B$_{[C+N]}$-ESAT6. Plasmid pHbpD-Ag85B$_{[C+N]}$-ESAT6 was created correspondingly, except that the NsiI/KpnI fragment of pHbpD-Ag85B$_{[C+N]}$ was substituted by that of pHbp(d4 in)-ESAT6.

Plasmid pHbp-Ag85B$_{[C+N]}$-ESAT6-Rv2660c is derivative of pHbp-Ag85B$_{[C+N]}$-ESAT6 encoding a version of Hbp-Ag85B$_{[C+N]}$-ESAT6 in which an amino acid sequence corresponding to Rv2660c was inserted into a flexible linker that was located as described for pHbp(Δd5). To construct pHbp-Ag85B$_{[C+N]}$-ESAT6-Rv2660c, the BstZ17i/KpnI fragment of pHbp-Ag85B$_{(C+N)}$-ESAT6 was substituted by that of pHbp (Δd5)-Rv2660c, yielding pHbp-Ag85B$_{(C+N)}$-ESAT6-Rv2660c. Plasmid pHbpD-Ag85B$_{(C+N)}$-ESAT6-Rv2660c was created correspondingly, except that the BstZ17i/KpnI fragment of pHbpD-Ag85B$_{(C+N)}$-ESAT6 was substituted by that of pHbp(Δd5)-Rv2660c.

Plasmid pEH3-EspC carries the full-length espC gene, the expression of which is under control of an inducible LacUV5 promoter. To construct pEH3-EspC, the espC gene was amplified by PCR using pJLM174 (Dutta et al 2002 Infect. Immun. 70, 7105-7113) as a template and the primers pEH_XbaI_EspC fw and EcoRI_EspC rv. The resulting PCR product was cloned into the XbaI/EcoRI sites of pEH3-Hbp. This step effectively exchanged the espC ORF for that of hbp, resulting in pEH3-EspC.

Plasmid pEH3-EspC(Δd1) is a pEH3-EspC derivative that carries an espC mutant that encodes a truncated version of EspC in which amino acid residues 54-300 of the full-length EspC amino acid sequence have been replaced by the amino acid sequence Gly-Ser-Ser-Ala-Gly-Ser-Gly-Ser-Gly (SEQ ID NO 46). The DNA sequence that encodes the latter amino acid sequence contains SacI and BamHI restriction sites that allow easy in-frame cloning of DNA sequences that encode heterologous amino acid sequences into the EspC(Δd1) coding sequence. To create pEH3-EspC(Δd1), a three-step 'overlapping extension PCR' procedure was carried out. In the first step a DNA fragment was amplified by PCR using pEH3-EspC as a template and the primers pEH_XbaI_EspC fw and EspC(Δdom1/Cas) rv. In the second step a DNA fragment was amplified by PCR using pEH3-EspC as a template and the primers EspC(Δdom1/Cas) fw and EspC(BglII) rv. In the third step a DNA fragment was amplified using a mixture of the PCR products from step 1 and 2 as template and the primers pEH_XbaI_EspC fw and EspC(BglII) rv. The PCR product from step three was cloned into pEH3-EspC using the XbaI and BglII restriction sites, yielding plasmid pEH3-EspC(Δd1).

Plasmid pEH3-EspC(Δd1)-ESAT6 is a pEH3-EspC(Δd1) derivative expressing EspC(Δd1) containing a heterologous insertion corresponding to the *mycobacterium tuberculosis* ESAT6 protein. To construct pEH3-EspC(Δd1)-ESAT6 a synthetic ESAT6-encoding DNA sequence possessing SacI and BamHI sites at the 5' and 3' side was obtained as described above. This allowed cloning of the synthetic ESAT6-encoding DNA sequence into the SacI and BamHI sites of pEH3-EspC(Δd1), yielding pEH3-EspC(Δd1)-ESAT6.

Plasmid pEH3$_{(p15a)}$-HbpD-Ag85B$_{[C+N]}$-ESAT6 (FIG. 34) is identical to plasmid pHbpD-Ag85B$_{[C+N]}$-ESAT6 except that a DNA fragment carrying the pMB1 origin of replication has been replaced by a fragment carrying a p15a origin of replication. To create pEH3$_{(p15a)}$-HbpD-Ag85B$_{[C+N]}$-ESAT6, plasmid pEH3$_{(p15a)}$-Hbp was created first. This plasmid was generated using pBAD33 (Guzman et al 1995 Journal of Bacteriology 177:4121-4130) as a template and the primers p15a fw and p15a rv (see Table 1). The resulting PCR fragment, carrying the p15a origin of replication, was cloned into pEH3-Hbp using the SalI/EcoRI restriction sites, yielding pEH3$_{(p15a)}$-Hbp. Subsequently, the XbaI/EcoRI fragment of pEH3$_{(p15a)}$-Hbp was substituted by that of pHbpD-Ag85B$_{[C+N]}$-ESAT6, creating pEH3$_{(p15a)}$-HbpD-Ag85B$_{[C+N]}$-ESAT6.

Description of Constructs Used in the Examples

For more detailed descriptions and how the constructs were made, see above under "Construction of plasmids".

FIG. 11 A shows the crystal structure of the passenger domain of the autotransporter Hbp (Otto et al 2005 J Biol Chem 280(17): 17339-45). Domain 1 (d1), domain 2 (d2) and the autochaperone domain (ac) are in light grey. The remainder of the passenger, including the beta stem domain is colored black.

FIG. 11 B shows the crystal structure of the passenger domain of the autotransporter Hbp (Otto et al 2005 J Biol Chem 280(17): 17339-45), rotated around the y-axis (50° counter clockwise) compared to the situation depicted in FIG. 11 A. The image was created using MacPyMol.

FIG. 11 C shows the crystal structure of the passenger domain of the autotransporter Hbp as in FIG. 11 B, but the residues that comprise domain 1 are hidden. Domain 3 (d3) is depicted in light grey. The remainder of the passenger is coloured black. The image was created using MacPyMol.

FIG. 11 D shows the crystal structure of the passenger domain of the autotransporter Hbp as in FIG. 11 C. Domain 4 (d4) and a side domain that corresponds to residues 898-922 (d5) of Hbp are depicted in light grey. The remainder of the passenger is coloured black. The image was created using MacPyMol.

FIG. 11 E shows schematic representations of Hbp-derivative constructs used in the examples. For the examples disclosed herein the Hbp-derivative constructs shown in FIG. 11 E were cloned into plasmids pEH3-Hbp[ΔBamHI] or pEH3-Hbp[Δβ-cleav/ΔBamHI] thus forming expression vectors corresponding to the vectors shown in FIGS. 3-10. FIG. 23 shows schematic representations of EspC-derivative constructs used in the examples. For SEQ ID NO:s of the constructs, see table 2.

TABLE 2

Constructs used in this study

| Name | Protein SEQ ID NO | DNA SEQ ID NO |
|---|---|---|
| Hbp(wild-type) | 1 | 48 |
| Hbp(Δβ-cleav) | 2 | 49 |
| HbpSS | 3 | 50 |
| Hbp(Δd1) (=HbpSL) | 4 | 51 |
| HbpD(Δd1) (=HbpDL) | 5 | 52 |
| Hbp(Δd2) | 6 | 53 |
| HbpD(Δd2) (=HbpDD2) | 7 | 54 |
| Hbp(Δd3) | 8 | 55 |
| Hbp(Δd4) | 9 | 56 |
| Hbp(Δd5) | 10 | 57 |
| Hbp(d4ins) | 11 | 58 |
| HbpSS-ESAT6 | 12 | 59 |
| Hbp(Δd1)-ESAT6 (=HbpSL-ESAT6) | 13 | 60 |
| HbpD(Δd1)-ESAT6 (=HbpDL-ESAT6) | 14 | 61 |
| Hbp(Δd2)-ESAT6 | 15 | 62 |
| HbpD(Δd2)-ESAT6 (=HbpDD2-ESAT6) | 16 | 63 |
| Hbp(Δd3)-ESAT6 | 17 | 64 |
| Hbp(Δd4)-ESAT6 | 18 | 65 |
| Hbp(Δd5)-ESAT6 | 19 | 66 |
| Hbp(d4ins)-ESAT6 | 20 | 67 |
| Hbp(βins)-ESAT6 | 21 | 68 |
| Hbp(Δd3)-Rv2660c | 22 | 69 |
| Hbp(Δd4)-Rv2660c | 23 | 70 |
| Hbp(Δd5)-Rv2660c | 24 | 71 |
| Hbp(Δd1)-TB10.4 | 25 | 72 |
| Hbp(Δd2)-TB10.3 | 26 | 73 |
| Hbp(Δd1)-hEGF(0ss) | 27 | 74 |
| Hbp-Ag85B$_{[N+C]}$ | 28 | 75 |
| HbpD-Ag85B$_{[N+C]}$ | 29 | 76 |
| Hbp-Ag85B$_{[C+N]}$ | 30 | 77 |
| HbpD-Ag85B$_{[C+N]}$ | 31 | 78 |
| Hbp-Ag85B$_{[C+N]}$-ESAT6 | 32 | 79 |
| HbpD-Ag85B$_{[C+N]}$-ESAT6 | 33 | 80 |
| Hbp-Ag85B$_{[C+N]}$-ESAT6-Rv2660c | 34 | 81 |
| HbpD-Ag85B$_{[C+N]}$-ESAT6-Rv2660c | 35 | 82 |
| EspC(wild-type) | 36 | 83 |
| EspC(Δd1) | 37 | 84 |
| EspC(Δd1)-ESAT6 | 38 | 85 |

Hbp(wild-type) is synthesized as a 1377 amino acid (aa) precursor that is organized in three domains: (i) an N-terminal cleavable signal sequence (ss; aa 1-52), (ii) a passenger domain (aa 53-1100) and (iii) an outer membrane integrated C-terminal translocator domain (β-domain; aa 1101-1377). Domain 1 (d1), domain 2 (d2), domain 3 (d3), domain 4 (d4), domain 5 (d5) and the autochaperone domain (ac) of the passenger domain are indicated. "FL" denotes flexible linker. The remainder of the passenger domain, including the beta stem domain is colored black. After passage of the outer membrane the passenger is cleaved from the translocator domain via an autocatalytic mechanism that involves hydrolysis of the peptide bond between Asn$^{1100}$ and Asn$^{1101}$ of the Hbp precursor. Numbers displayed above the diagrams correspond to the amino acid positions of the original Hbp (wild-type) precursor, calculated from the n-terminus.

"E-6" indicates ESAT6. "26" indicates Rv2660c. "10.3" indicates TB10.3 and "10.4" indicates TB10.4". "EGF" indicates hEGF(0ss). "85[N]" indicates Ag85B$_{[N]}$ and "85[C]" indicates Ag85B$_{[C]}$.

Hbp(Δβ-cleav) represents a mutant of Hbp(wild-type) of which the passenger cannot be cleaved from the translocator domain due to disruption of the cleavage site (black cross) by substitution of Asn$^{1100}$ and Asn$^{1101}$ by a Gly and a Ser residue, respectively.

HbpSS represents a mutant of Hbp in which the vast majority of the passenger, except the autochaperone domain has been substituted by a flexible linker (FL) hat allows insertion of heterologous protein sequences.

Hbp(Δd1), Hbp(Δd2), Hbp(Δd3), Hbp(Δd4) and Hbp(Δd5) represent mutants of Hbp in which domain 1, 2, 3, 4 and 5, respectively, of the passenger has been substituted by a flexible linker. Hbp(Δd1) is the same as HbpSL.

HbpD(Δd1) and HbpD(Δd2) are identical to Hbp(Δd1) and Hbp(Δd2), respectively, except that the cleavage site between the passenger and the translocator domain was disrupted as described for Hbp(Δβ-cleav). HbpD(Δd1) has also been named HbpDL and HbpD(Δd2) has been named HppDD2.

Hbp(d4ins) is a mutant of Hbp in which residues 760-764—located in domain 4—have been substituted by a flexible linker.

HbpSS-ESAT6, Hbp(Δd1)-ESAT6, HbpD(Δd1)-ESAT6, Hbp(Δd2)-ESAT6, HbpD(Δd2)-ESAT6, Hbp(Δd3)-ESAT6, Hbp(Δd4)-ESAT6, Hbp(Δd5)-ESAT6 and Hbp(d4ins)-ESAT6 are derivatives of HbpSS, Hbp(Δd1), HbpD(Δd1), Hbp(Δd2), HbpD(Δd2), Hbp(Δd3), Hbp(Δd4), Hbp(Δd5) and Hbp(d4ins), respectively. In these derivatives, an amino acid sequence corresponding to the ESAT6 the protein of *Mycobacterium tuberculosis* was inserted into the flexible linker, leaving short flexible spacers comprising Gly and Ser residues between the natural Hbp sequence and the N' and C' terminus of ESAT6.

Hbp(βins)-ESAT6 is a mutant of Hbp in which an amino acid sequence corresponding to ESAT6 and short N' and C' flanking, flexible spacers has been inserted in a β-strand forming sequence of the Hbp passenger domain: between residues 771 and 772.

Hbp(Δd3)-Rv2660c, Hbp(Δd4)-Rv2660c and Hbp(Δd5)-Rv2660c are derivatives of Hbp(Δd3), Hbp(Δd4) and Hbp(Δd5), respectively. In these derivatives, an amino acid sequence corresponding to the protein Rv2660c of *Mycobacterium tuberculosis* was inserted into the flexible linker as described for Hbp(Δd3), Hbp(Δd4) and Hbp(Δd5) respectively.

Hbp(Δd1)-TB10.4 is a derivative of Hbp(Δd1) in which an amino acid sequence corresponding to the protein TB10.4 of *Mycobacterium tuberculosis* was inserted into the flexible linker as described for Hbp(Δd1).

Hbp(Δd2)-TB10.3 is a derivative of Hbp(Δd2) in which an amino acid sequence corresponding to the protein TB10.3 of *Mycobacterium tuberculosis* was inserted into the flexible linker as described for Hbp(Δd2).

Hbp(Δd1)-hEGF(0ss) is a derivative of Hbp(Δd1) in which an amino acid sequence corresponding to a cysteineless mutant of the protein hEGF of *Homo sapiens* was inserted into the flexible linker as described for Hbp(Δd1).

Hbp-Ag85B$_{[N+C]}$ is a mutant of Hbp in which an amino acid sequence corresponding to residues 1-126 of the mature region of the protein Ag85B from *Mycobacterium tuberculosis* (Ag85B$_{[N]}$) was inserted into a flexible linker that was located as described for Hbp(Δd1). In addition, an amino acid sequence corresponding to residues 118-285 of the mature region of the protein Ag85B (Ag85B$_{[C]}$) was inserted into a flexible linker that was located as described for Hbp(Δd2).

Hbp-Ag85B$_{[C+N]}$ is a mutant of Hbp in which an amino acid sequence corresponding to residues 1-126 of the mature region of the protein Ag85B from *Mycobacterium tuberculosis* (Ag85B$_{[N]}$) was inserted into a flexible linker that was located as described for Hbp(Δd2). In addition, an amino acid sequence corresponding to residues 118-285 of the e mature region of the protein Ag85B (Ag85B$_{[C]}$) was inserted into a flexible linker that was located as described for Hbp(Δd1).

Hbp-Ag85B$_{[C+N]}$-ESAT6 is derivative of Hbp-Ag85B$_{[C+N]}$ in which an amino acid sequence corresponding to ESAT6 was inserted into a flexible linker that was located as described for Hbp(d4ins). Thus Ag85B$_{[C']}$ is inserted at d1, Ag85B$_{[N']}$ inserted at d2 and ESAT6 inserted at d4.

Hbp-Ag85B$_{[C+N]}$-ESAT6-Rv2660c is a derivative of Hbp-Ag85B$_{[C+N]}$-ESAT6 in which an amino acid sequence corresponding to Rv2660c was inserted into a flexible linker that was located as described for Hbp(Δd5). Thus Ag85B$_{[C']}$ is inserted at d1, Ag85B$_{[N']}$ inserted at d2, ESAT6 inserted at d4 and Rv2660c inserted at d5.

HbpD-Ag85B$_{[C+N]}$, HbpD-Ag85B$_{[C+N]}$-ESAT6 and HbpD-Ag85B$_{[C+N]}$-ESAT6-Rv2660c are derivatives of Hbp-Ag85B$_{[C+N]}$, Hbp-Ag85B$_{[C+N]}$-ESAT6 and Hbp-Ag85B$_{[C+N]}$-ESAT6-Rv2660c, respectively, except that the cleavage site between the passenger and the translocator domain was disrupted as described for Hbp(Δβ-cleav).

General Procedures

SDS-PAGE was performed using 4-12% NuPAGE Bis-Tris gels (Invitrogen) with a MES-SDS running buffer. Alternatively, SDS-PAGE was performed using 10%, 4-15% or 'any-kD' Biorad mini-Protean TGX gels, or standard 10% SDS-PAGE gels. Before subjection to SDS-PAGE, protein samples were dissolved in SDS-PAGE sample buffer (63 mM TrisHcl pH 6.8, 2% w/v SDS, 10% glycerol, 0.01% w/v bromophenol blue, 41 mM DTT) and boiled for 5 min. Gels were stained with Coomassie Brilliant Blue G-250 and captured using a Molecular Imager GS-800 Calibrated Densitometer (Biorad). Alternatively, gels were subjected to Western blotting. Where appropriate, Western blots were incubated with rabbit polyclonal antibodies directed against either the Hbp passenger domain, the Hbp translocator domain, or the outer membrane protein OmpA. Alternatively, Western blots were incubated with mouse monoclonal antibodies directed against *Mycobacterium tuberculosis* ESAT6 or Ag85B, or with a rat polyclonal antiserum directed against Rv2660c. Subsequently, Western blots were incubated with horse-radish peroxidase (HRP) conjugated goat anti-rabbit antibodies (Rockland Immunochemicals), HRP-conjugated rabbit anti-mouse antibodies or HRP-conjugated rabbit anti-rat antibodies, where appropriate. Western blots were developed using chemiluminescent LumiLight Western blotting substrate (Roche). Chemiluminescent signals were detected and digitalized using a ChemiDoc XRS+ Molecular Imager (Bio-Rad).

Example 1

Expression and Biogenesis of Hbp Secretion and Display Constructs (FIG. 12).

This example illustrates proper expression and biogenesis of Hbp constructs designed for the secretion or display of heterologous amino acid sequences. Constructs carrying an intact cleavage site between the passenger and the translocator domain (HbpSS and HbpSL) are properly processed yielding translocator domains that are integrated into the outer membrane and passengers that are secreted into the medium. Expression of constructs carrying a disrupted cleavage site between the passenger and the translocator domain (HbpDL and HbpDD2) yield passengers that remain covalently attached to the translocator domain and, hence, cell-associated.

Expression and secretion of Hbp, Hbp(Δβ-cleav), HbpSS, HbpSL (also named Hbp(Δd1)), HbpDL (also named HbpD (Δd1)) and HbpDD2 (also named HbpD(Δd2)). *E. coli* MC1061 cells harboring the constructs cloned into the expression vector pEH3 from overnight cultures were subcultured in fresh medium and their growth was continued. When cultures reached early log phase ($OD_{660}\approx 0.3$), expression of Hbp(derivatives) was induced with 1 mM of IPTG. Samples were collected from the cultures 2 h after induction and cells (c) and spent medium (m) were separated by low speed centrifugation. Cells were directly solubilized in SDS-PAGE sample buffer whereas medium samples were subjected to TCA precipitation first. Samples corresponding to 0.03 $OD_{660}$ units of cells were analyzed by SDS-PAGE and Coomassie staining (A). Samples corresponding to 0.003 $OD_{660}$ units of cells were analyzed by SDS-PAGE and Western blotting using either polyclonal antibodies directed against the full-length Hbp passenger domain (B) or polyclonal antibodies directed against an N-terminal epitope of the Hbp translocator domain (C). Molecular mass (kDa) markers are indicated at the left side of the panels. The processed passenger domains (>), processed translocator domains (#) and non-processed pro-forms comprising both a passenger and translocator domain (*) of the constructs are indicated.

Example 2

Expression and Biogenesis of Hbp Secretion Constructs Carrying a Heterologous Protein (FIG. 13).

This example illustrates that an heterologous protein ESAT6 is efficiently transported to the extracellular environment (culture medium) via the Hbp autotransporter system when fused to the Hbp passenger at the position of domain 1 of the passenger (HbpSL-ESAT6). This example also shows that for the secretion of heterologous proteins it is necessary to keep the beta stem of the Hbp passenger domain intact. This follows from the observation that fusion of ESAT6 to an Hbp construct of which the passenger has been N' truncated up to the autochaperone domain (HbpSS-ESAT6) does not result in detectable amounts of ESAT6 in the culture medium.

Expression and secretion of Hbp, HbpSS, HbpSS-ESAT6, HbpSL (Hbp(Δd1)) and HbpSL-ESAT6 (also named Hbp (Δd1)-ESAT6). *E. coli* MC1061 cells harbouring the constructs cloned into the expression vector pEH3 or an empty vector (lane 1) from overnight cultures were subcultured in fresh medium and their growth was continued. When cultures reached early log phase ($OD_{600}\approx 0.3$), expression of Hbp(derivatives) was induced with 1 mM of IPTG. Samples were collected from the cultures 2 h after induction and cells (c) and spent medium (m) were separated by low speed centrifugation. Cells were directly solubilized SDS-PAGE sample buffer whereas medium samples were subjected to TCA precipitation first. Samples corresponding to 0.03 $OD_{660}$ units of cells were analyzed by SDS-PAGE and Coomassie staining (A). Samples corresponding to 0.003 $OD_{660}$ units of cells were analyzed by SDS-PAGE and Western blotting using either polyclonal antibodies directed against an N-terminal epitope of the Hbp translocator domain (B), polyclonal antibodies directed against the full-length Hbp passenger domain (C) or monoclonal antibodies against the 10 kDa *Mycobacterium tuberculosis* protein ESAT6 (E6) (D). Molecular mass (kDa) markers are indicated at the left side of the panels. The processed passenger domains (>), processed translocator domains (#) and non-processed pro-forms comprising both a passenger and translocator domain (*) of the constructs are indicated.

Example 3

Figure 14:
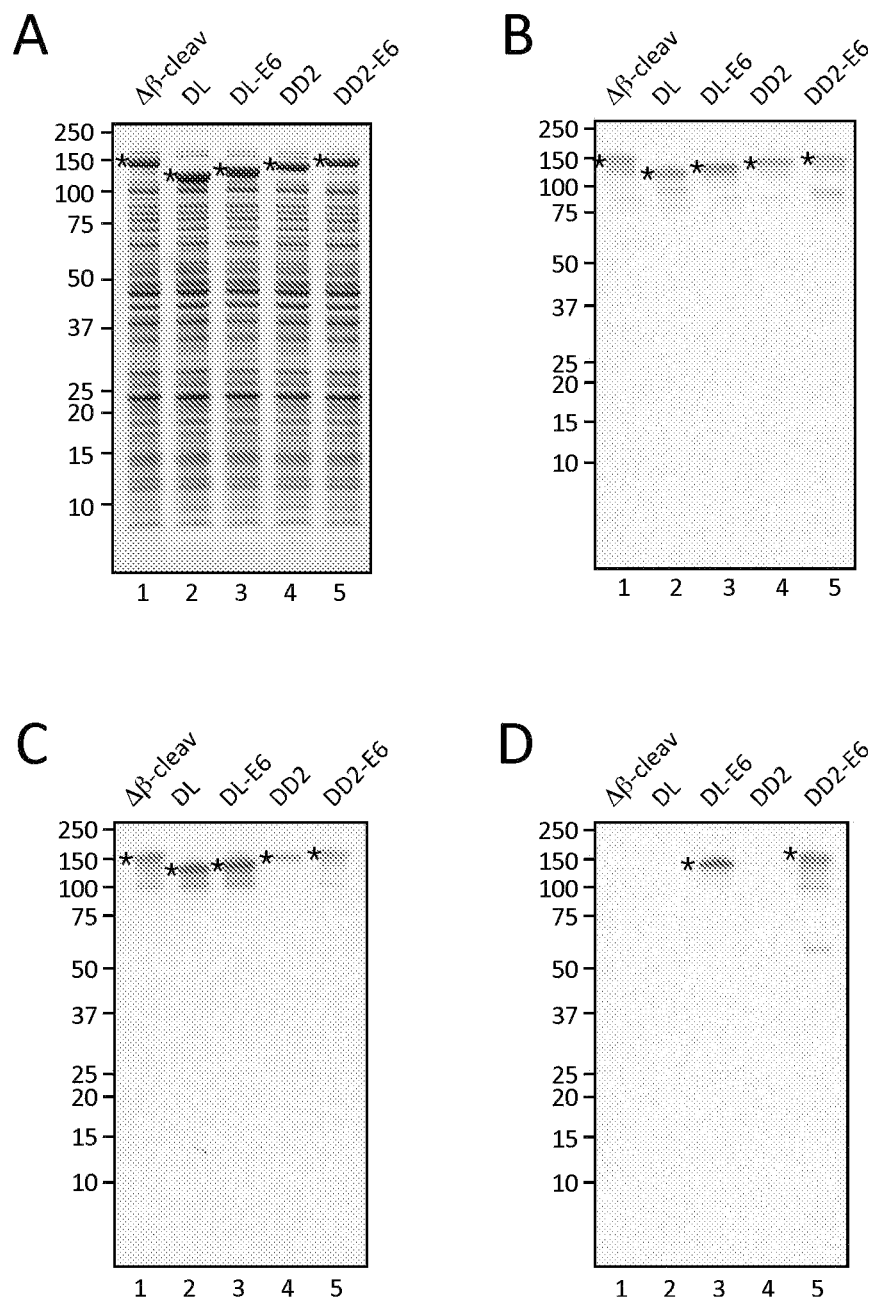

Expression and Biogenesis of Hbp Display Constructs Carrying a Heterologous Protein (FIG. 14).

This example illustrates that an heterologous protein ESAT6 is stably expressed when fused to the Hbp passenger at the position of domain 1 (HbpDL-ESAT6) or domain 2 (HbpDD2-ESAT6) in an Hbp derivative carrying a disrupted cleavage site between the passenger and the translocator domain.

Expression and secretion of Hbp($\Delta\beta$-cleav), HbpDL (Hbp-D($\Delta$d1)), HbpDL-ESAT6 (Hbp($\Delta$d1)-ESAT6), HbpDD2 (HbpD($\Delta$d2) and HbpDD2-ESAT6 (HbpD($\Delta$d2)-ESAT6). *E. coli* MC1061 cells harbouring the constructs cloned into the expression vector pEH3 from overnight cultures were subcultured in fresh medium and their growth was continued. When cultures reached early log phase ($OD_{660} \approx 3$), expression of Hbp-derivatives was induced with 1 mM of IPTG. After 2 hours of induction cells were collected by low speed centrifugation and solubilized in SDS-PAGE sample buffer. Samples corresponding to 0.03 $OD_{660}$ units of cells were analyzed by SDS-PAGE and Coomassie staining (A). Samples corresponding to 0.003 $OD_{660}$ units of cells were analyzed by SOS-PAGE and Western blotting using either polyclonal antibodies directed against an N-terminal epitope of the Hbp translocator domain (B), polyclonal antibodies directed against the full-length Hbp passenger domain (C) or monoclonal antibodies against the 10 kDa *Mycobacterium tuberculosis* protein ESAT6 (E6) (D). Molecular mass (kDa) markers are indicated at the left side of the panels. The non-processed pro-forms comprising both a passenger and translocator domain (*) of the constructs are indicated.

Example 4

Figure 15:
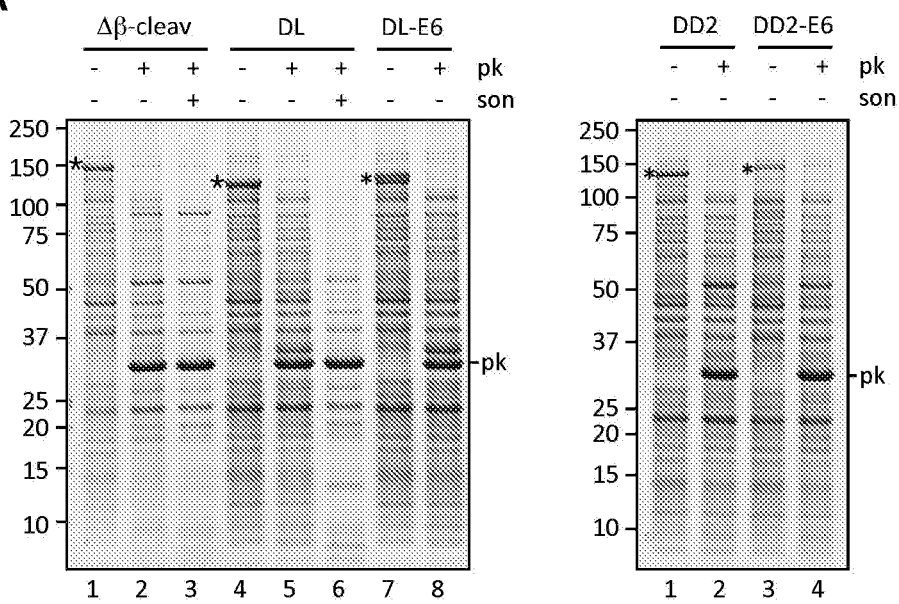
Figure 15:
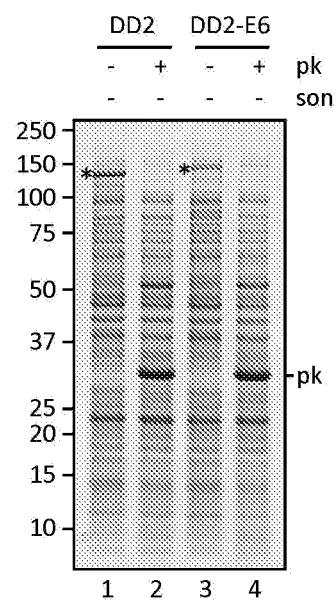
Figure 15:
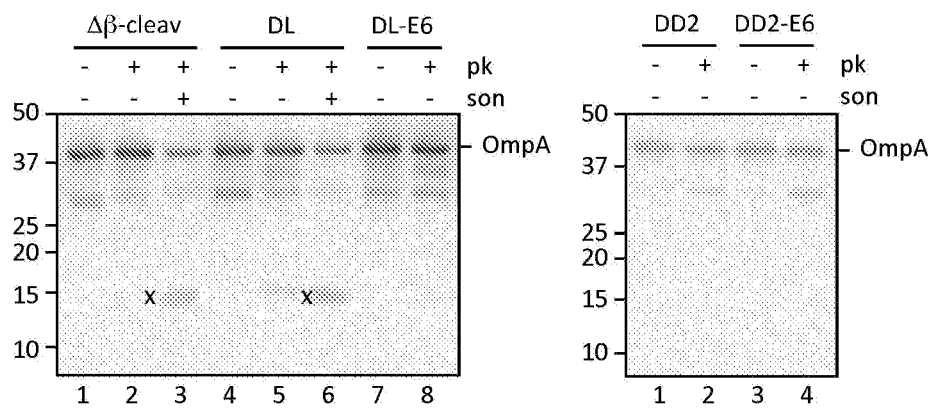
Figure 15:
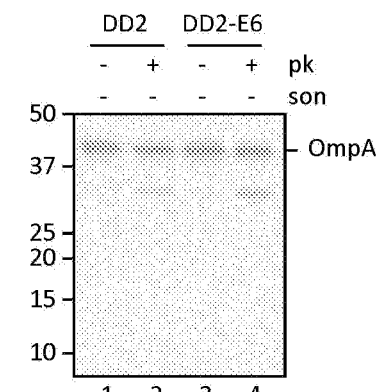

Proteinase k Accessibility of Hbp-ESAT6 Fusions Displayed at the Cell Surface (FIG. 15).

This example illustrates that the passengers of HbpDL and HbpDD2 carrying ESAT6 are accessible to and, hence, degraded by proteinase k added to intact cells, indicating that they are exposed to the cell surface.

Proteinase k accessibility of Hbp($\Delta\beta$-cleav), HbpDL (HbpD($\Delta$d1)), HbpDL-ESAT6 (HbpD($\Delta$d1)-ESAT6), HbpDD2 (HbpD($\Delta$d2)) and HbpDD2-ESAT6 (HbpD($\Delta$d2)-ESAT6). *E. coli* MC1061 cells harbouring the constructs cloned into the expression vector pEH3 from overnight cultures were subcultured in fresh medium and their growth was continued. When cultures reached early log phase ($OD_{660} \approx 0.3$), expression of Hbp-derivatives was induced with 1 mM of IPTG. Cells were collected from the cultures 2 h after induction by low speed centrifugation and resuspended in 50 mM Tris-HCl, PH 7.4, containing 1 mM CaCl. In the case of Hbp($\Delta\beta$-cleav) and HbpDL, half of the cells were lysed by sonication on ice using a tip sonicator (Branson Sonifier 250). Subsequently, all samples were incubated with proteinase k (pk)(100 µg/ml) at 37° C. for 1 hour. The reaction was stopped by addition of 0.1 mM phenylmethylsulfonyl fluoride (PMSF) and incubation on ice for 5 min. Samples were subjected to TCA precipitation before solubilization in SDS-PAGE sample buffer. To monitor the accessibility of Hbp constructs displayed on intact cells to proteinase k, samples corresponding to 0.03 $OD_{660}$ units of cells were analyzed by SDS-PAGE and Coomassie staining (A). As a control, samples corresponding to 0.003 $OD_{660}$ units of cells were analyzed by SDS-PAGE and Western blotting using polyclonal antibodies directed against the outer membrane protein OmpA which is naturally inaccessible to proteinase k unless cells are lysed by e.g. sonication (son)(B). An OmpA degradation product that emerges upon proteinase k treatment is indicated (x). Molecular mass (kDa) markers are indicated at the left side of the panels. The non-processed pro-forms comprising both a passenger and translocator domain (*) of the constructs are indicated. The position of proteinase K (pk) is indicated at the right hand side of the panels.

Example 5

Figure 16:
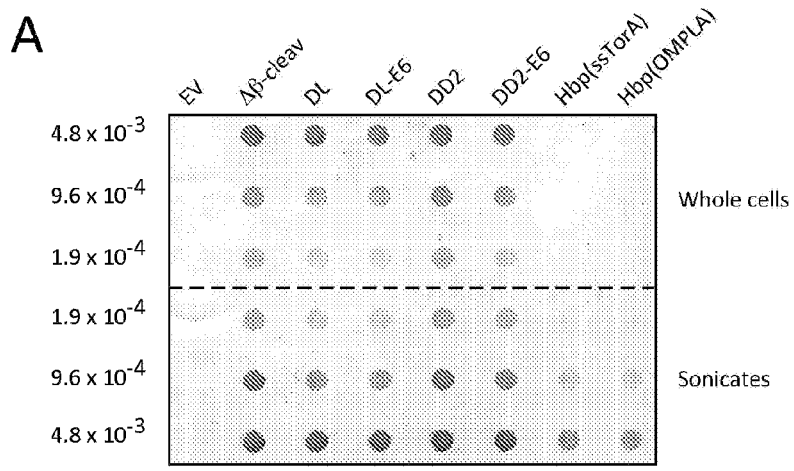
Figure 16:
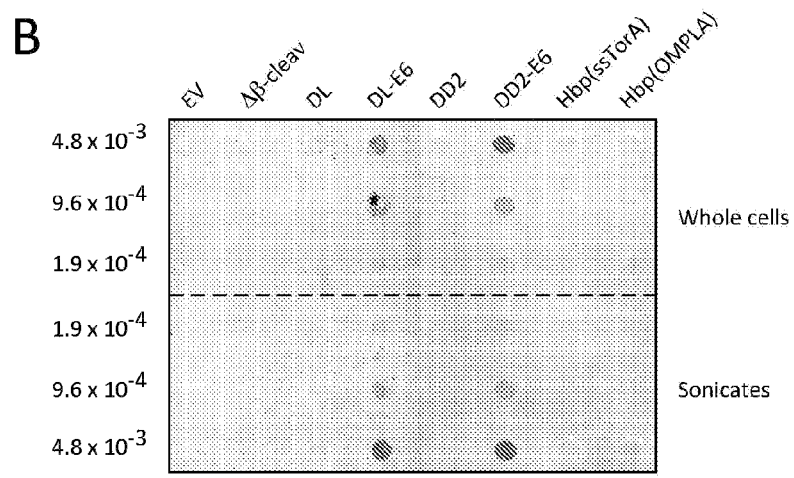
Figure 16:
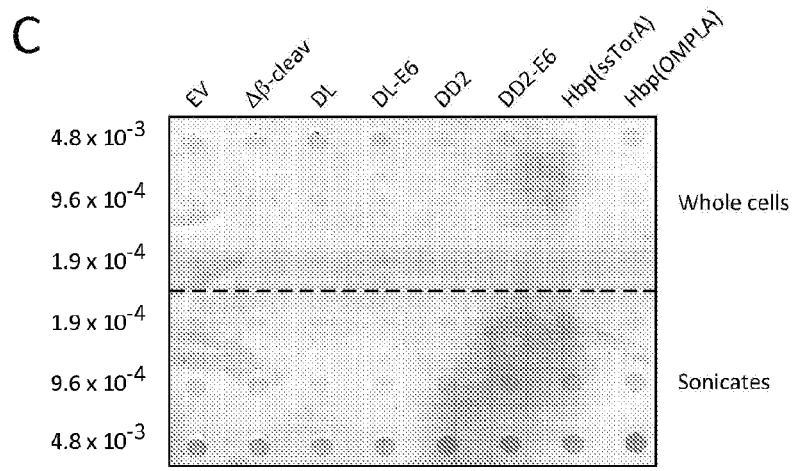

Display of ESAT6 at the Cell Surface (FIG. 16).

This example illustrates that the heterologous protein ESAT6 fused to the passenger of HbpDL or HbpDD2 is accessible to specific antibodies added to intact cells, indicating efficient display of ESAT6 at the cell-surface.

Surface display analysis of Hbp($\Delta\beta$-cleav), HbpDL (HbpD($\Delta$d1)), HbpDL-ESAT6 (HbpD($\Delta$d1)-ESAT6), HbpDD2 (HbpD($\Delta$d2)) and HbpDD2-ESAT6 (HbpD($\Delta$d2)-ESAT6) and the secretion incompetent Hbp(ssTorA) and Hbp(OMPLA). Hbp(ssTorA) is a mutant of Hbp which has its native signal peptide replaced by the signal peptide of the protein TorA. Because the TorA signal peptide does not target Hbp to the Sec translocon, no translocation across the inner membrane takes place and Hbp remains in the cytoplasm. Hbp (OMPLA) is a mutant of Hbp which has its native translocator domain replaced by the outer membrane protein OMPLA. OMPLA does target the Hbp passenger to the outer membrane but does not mediate its translocation across the outer membrane. Hence, the Hbp passenger remains orientated towards the periplasm and not to the extracellular milieu.

*E. coli* MC1061 cells harbouring the constructs cloned into the expression vector pEH3, or an empty vector (EV), from overnight cultures were subcultured in fresh medium and their growth was continued. When cultures reached early log phase ($OD_{660} \approx 0.3$), expression of Hbp-derivatives was induced with 1 mM of IPTG. Cells were collected 1 hour after induction by low speed centrifugation, washed in icecold 50 mM Tris-HCl, PH 7.4, and eventually resuspended in ice-cold 50 mM Tris-HCl, PH 7.4 and left on ice. Half of each sample was subjected to tip sonication on ice (Branson Sonifier 250) to lyse the cells, whereas the cells of the other half were left intact. Subsequently, a five-fold dilution range of each sample was prepared in icecold 50 mM Tris-HCl, pH 7.4. Dilutions of each sample were applied on presoaked nitrocellulose membranes using a vacuum manifold based Bio-Dot apparatus (Biorad). Membranes were blocked upon incubation in a 5% skimmed milk solution in TBS for 20 min. To detect surface exposure of the passenger of Hbp-derivatives, membranes were incubated with rabbit polyclonal antibodies directed against the Hbp passenger in TBS for 1 h, washed 3 times with TBS, incubated with HRP conjugated goat anti-rabbit antibodies in TBS for 45 min, washed 3 times with TBS and developed using di-octylsodiumsulphosuccinate (DONS) staining (A). This confirmed surface-exposure of the passengers of Hbp($\Delta\beta$-cleav), HbpDL, HbpDL-ESAT6, HbpDD2 and HbpDD2-ESAT6 on whole cells as opposed to the passengers of secretion-incompetent mutants Hbp(ssTorA) and Hbp(OMPLA) the expression of which was apparent from the corresponding sonicated samples.

To demonstrate display of ESAT6 by HbpDL-ESAT6 and HbpDD2-ESAT6 on whole cells the same procedure was followed as under A except that mouse monoclonal antibodies directed against ESAT6 were used and HRP conjugated rabbit anti-mouse antibodies (B). As a control, it was demonstrated that a periplasmic protein OppA could not be efficiently detected on whole cells as opposed to the sonicated samples. For this, the same procedure was used as described under A except that a rabbit polyclonal antiserum against OppA was used (C). At the left hand side of the panels the amount of material (in $OD_{660}$ units) applied is indicated.

Example 6

Figure 17:
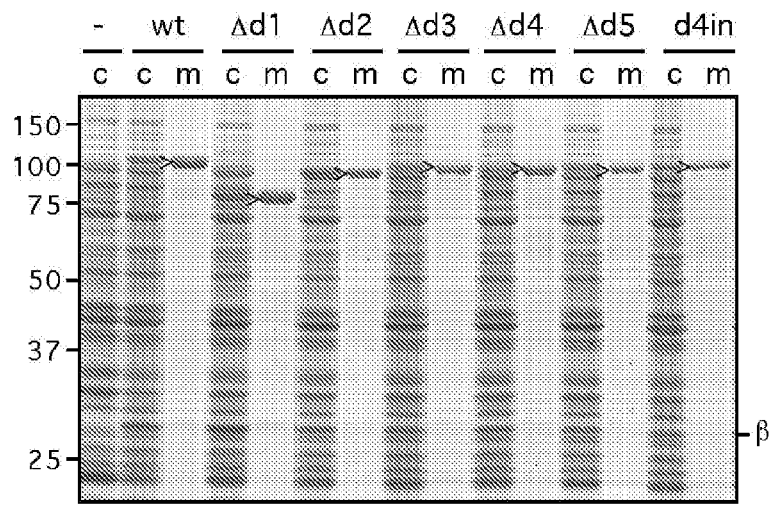

Biogenesis of Hbp Upon (Partial) Deletion of Side Domains (FIG. 17)

This example illustrates successful secretion of Hbp upon replacement of either of the side domains 1 to 5 by a flexible amino acid linker sequence (Δd1-Δd5). Furthermore, successful secretion of an insertion mutant (d4ins) is shown in which only 4 amino acids of domain 4 are replaced by a flexible linker.

Expression and secretion of Hbp, Hbp(Δd1), Hbp(Δd2), Hbp(Δd3), Hbp(Δd4), Hbp(Δd5) and Hbp(d4ins). *E. coli* MC1061 cells harbouring the constructs cloned into the expression vector pEH3 or an empty vector (–) from overnight cultures were subcultured in fresh medium and their growth was continued. When cultures reached early log phase ($OD_{660}$≈0.3), expression of Hbp(derivatives) was induced with 1 mM of IPTG. Samples were collected from the cultures 2 h after induction and cells (c) and spent medium (m) were separated by low speed centrifugation. Cells were directly solubilized SDS-PAGE sample buffer whereas medium samples were subjected to TCA precipitation first. Samples corresponding to 0.03 $OD_{660}$ units of cells were analyzed by SDS-PAGE and Coomassie staining.

Proper secretion follows from the appearance of cleaved passenger domain (>) in the cell fraction (c) and culture medium (m), and cleaved translocator domain (β) in the cell fraction, similar to wild-type Hbp (wt) (FIG. 17). Molecular mass (kDa) markers are indicated at the left side of the panel.

Example 7

Figure 18:
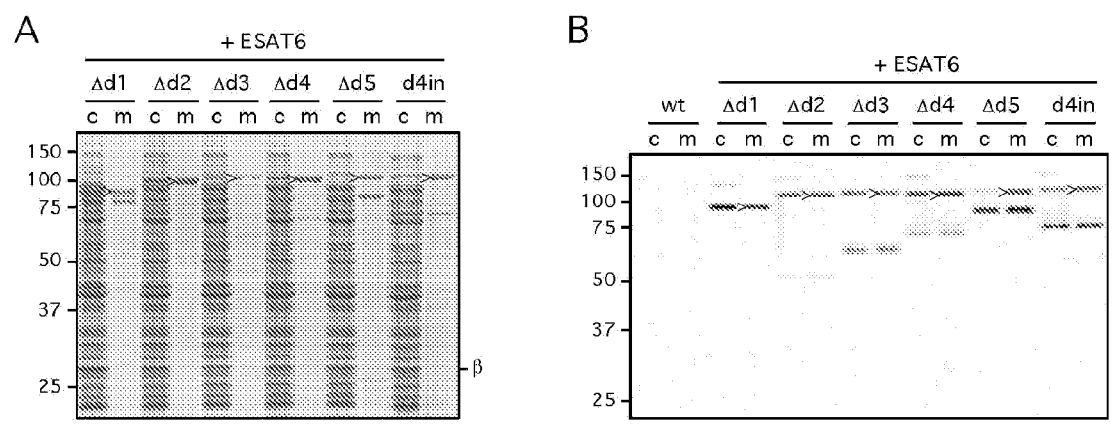
Figure 19:
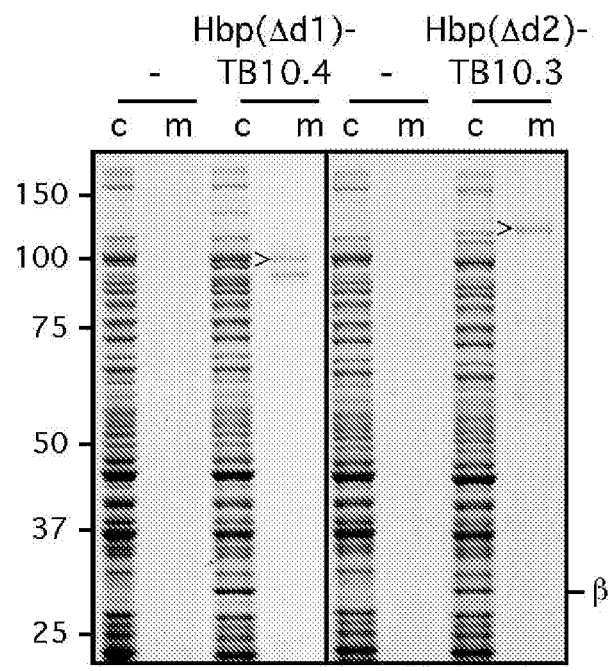
Figure 20:
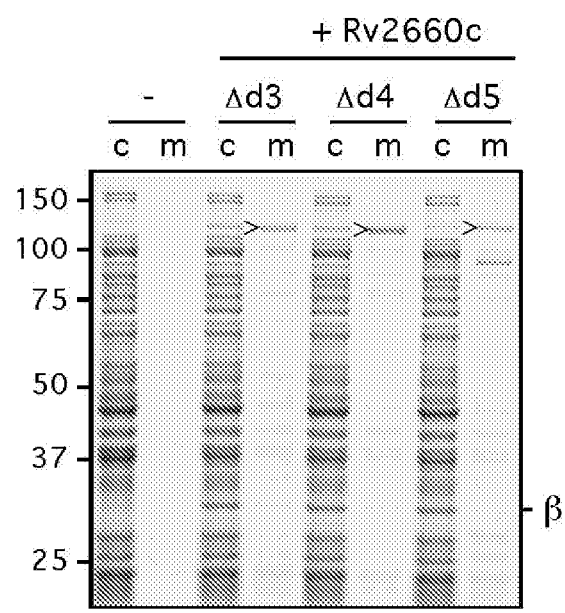
Figure 21:
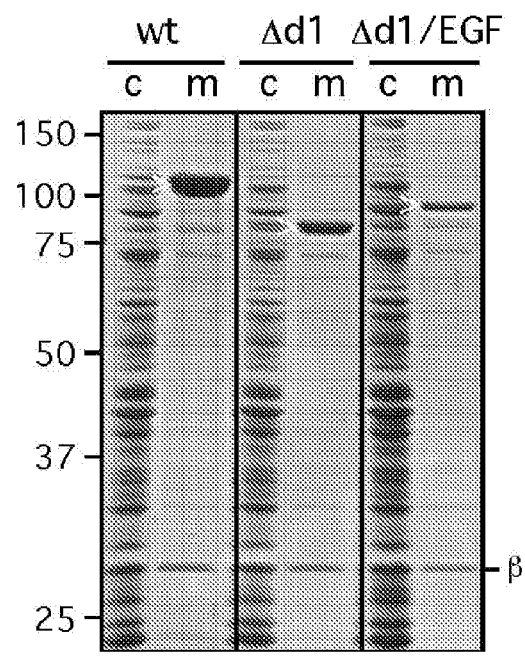

Secretion of ESAT6 Fused to the Position of Either of the Domains d1 to d5 (FIG. 18)

This example illustrates efficient secretion of the *Mycobacterium tuberculosis* antigen ESAT6 upon fusion to the Hbp passenger domain at the position of either of the domains d1 to d5, or insertion into domain 4 (d4ins).

Expression and secretion Hbp(Δd1)-ESAT6, Hbp(Δd2)-ESAT6, Hbp(Δd3)-ESAT6, Hbp(Δd4)-ESAT6, Hbp(Δd5)-ESAT6 and Hbp(d4ins)-ESAT6. (A) *E. coli* MC1061 cells harbouring the constructs cloned into the expression vector pEH3 were grown, induced and analyzed as described under Example 6. (B) Samples from A corresponding to 0.003 $OD_{660}$ units of cells were analyzed by Western blotting using monoclonal antibodies directed against ESAT6.

Proper secretion follows from the appearance of cleaved passenger domain (>) in the cell fraction (c) and culture medium (m), and cleaved translocator domain (β) in the cell fraction (FIG. 18 A). The presence of ESAT6 in the respective passenger domains is confirmed by Western blotting using ESAT6 specific antibodies (FIG. 18 B). Molecular mass (kDa) markers are indicated at the left side of the panels.

Example 8

Secretion of TB10.3 and TB10.4 Upon Replacement of Domain d1 or d2 (FIG. 19)

This example illustrates efficient secretion of the *Mycobacterium tuberculosis* proteins TB10.3 and TB10.4 upon replacement of domain d2 and domain d1 of the Hbp passenger, respectively.

Expression and secretion of Hbp(Δd1)-TB10.4 and Hbp(Δd2)-TB10.3. *E. coli* TOP10F' cells harbouring the constructs cloned into the expression vector pEH3, or carrying a non-expressing plasmid (–), were grown and induced as described under Example 6. Samples were withdrawn from the cultures 2 h after induction. Subsequently, cells were isolated by centrifugation, solubilized in SDS-PAGE sample buffer and analyzed by Coomassie stained SDS-PAGE.

Proper secretion follows from the appearance of cleaved passenger domain (>) in the cell fraction (c) and culture medium (m), and cleaved translocator domain (β) in the cell fraction (FIG. 19). Molecular mass (kDa) markers are indicated at the left side of the panel.

Example 9

Secretion of Rv2660c Fused to the Position of Either of the Domains d3, d4 or d5 (FIG. 20)

This example illustrates efficient secretion of the *Mycobacterium tuberculosis* antigen Rv2660c upon fusion to the Hbp passenger domain at the position of domain 3, domain 4 or domain 5.

Expression and secretion of Hbp(Δd3)/Rv2660c, Hbp(Δd4)/Rv2660c, Hbp(Δd5)/Rv2660c. *E. coli* MC1061 cells harbouring the constructs cloned into the expression vector pEH3 were grown, induced and analyzed as described under Example 6.

Proper secretion follows from the appearance of cleaved passenger domain (>) in the cell fraction (c) and culture medium (m), and cleaved translocator domain (β) in the cell fraction (FIG. 20). Molecular mass (kDa) markers are indicated at the left side of the panel.

Example 10

Secretion of Cysteinless hEGF (FIG. 21)

This example illustrates efficient secretion of a cysteineless (0ss) version of the *Homo sapiens* protein hEGF (EGF) upon fusion to the Hbp passenger domain at the position of domain 1.

Expression and secretion of Hbp(wild-type), Hbp(Δd1) and Hbp(Δd1)-hEGF(0ss). *E. coli* MC1061 cells harbouring the constructs cloned into the expression vector pEH3 were grown overnight in M9 medium supplemented with glucose (0.4%), chloramphenicol (20 μg/ml) and Streptomycin (30 μg/ml) at 37° C. Next morning cells were subcultured in fresh medium and their growth was continued. When cultures reached early log phase ($OD_{660}$≈0.3), expression of Hbp(derivatives) was induced with 1 mM of IPTG. Samples were collected from the cultures 3 h after induction and cells (c) and spent medium (m) were separated by low speed centrifugation. Cells were directly solubilized SDS-PAGE sample buffer whereas medium samples were subjected to TCA precipitation first. Cell samples corresponding to 0.05 $OD_{660}$ units and medium samples corresponding to 0.1 $OD_{660}$ units were analyzed by SDS-PAGE and Coomassie staining.

Proper secretion follows from the appearance of cleaved passenger domain (>) in the cell fraction (c) and culture medium (m), and cleaved translocator domain (β) in the cell fraction (FIG. 21). Molecular mass (kDa) markers are indicated at the left side of the panel.

Example 11

Figure 22:
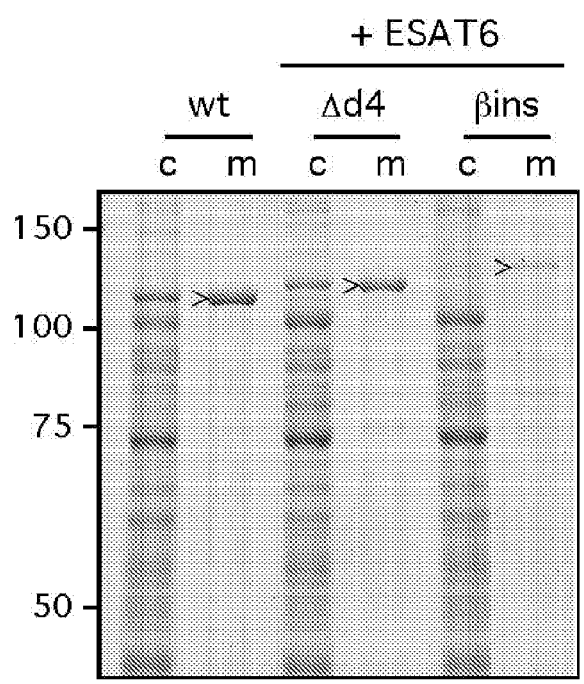

Impaired Secretion of ESAT6 Upon Insertion into β-Stem Forming Sequence (FIG. 22)

This example illustrates that insertion of ESAT6 in the β-stem forming sequence of the Hbp passenger domain (βins-ESAT6) yields inefficient secretion as compared to replacement of side domain d4 by ESAT6 (Δd4-ESAT6). Of note, the ESAT6 fusion sites in the respective constructs are only 5 amino acid residues apart.

Expression and secretion of Hbp(wild-type), Hbp(Δd4)-ESAT6 and Hbp(βins)-ESAT6. *E. coli* MC1061 cells harbouring the constructs cloned into the expression vector pEH3 were grown and induced as described under Example 6. Samples were withdrawn from the cultures 2 h after induction. Subsequently, cells were isolated by centrifugation, solubilized in SDS-PAGE sample buffer and analyzed by Coomassie stained SDS-PAGE. Molecular mass (kDa) markers are indicated at the left side of the panels. Cleaved Hbp passenger species are indicated (>).

Example 12

Secretion of ESAT6 Upon Fusion to an Alternative Autotransporter (FIG. 23-24)

This example illustrates that the methodology used to secrete heterologous proteins via the Hbp secretion system is applicable to an alternative autotransporter (AT); EspC.

FIG. 23 A shows a model of the EspC passenger domain structure. The structure was predicted in silico using the M4T homology modeling method (Rykunov et al 2009 J Struct Funct Genomics 10: 95-99). The primary amino acid sequence corresponding to the EspC passenger domain (residues 54-1028 of the protein with accession number Q9EZE7) was used as input. Side domains protruding from the β stem were identified. Domain 1 (d1) is in light grey. The remainder of the passenger domain, including the beta stem domain is colored black. Domain d1 is suitable for replacement by a POI.

FIG. 23 B shows schematic representations of EspC derivatives used in the examples. EspC(wild-type) is synthesized as a 1306 amino acid (aa) precursor that is organized in three domains: (i) an N-terminal cleavable signal sequence (ss; aa 1-53), (ii) a passenger domain (aa 54-1028) and (iii) an outer membrane integrated C-terminal translocator domain (β-domain; aa 1029-1306). The predicted domain 1 (d1) is indicated. The remainder of the passenger domain, including the beta stem domain, is colored black. "FL" denotes flexible linker. "E-6" indicates ESAT6. After passage of the outer membrane, the passenger is cleaved from the translocator domain (β-domain) via an autocatalytic mechanism that involves hydrolysis of the peptide bond between $Asn^{1028}$ and $Asn^{1029}$ of the EspC precursor. Numbers displayed above the diagrams correspond to the amino acid positions of the original EspC(wild-type) precursor, calculated from the n-terminus.

Expression and secretion of EspC, EspC(Δd1), and EspC (Δd1)-ESAT6. (FIG. 24 A) *E. coli* MC1061 cells harbouring the constructs cloned into the expression vector pEH3 were grown, induced and analyzed as described under Example 6. (FIG. 24 B) Samples from A corresponding to 0.003 $OD_{660}$ units of cells were analyzed by Western blotting using monoclonal antibodies against ESAT6.

Here, it is shown that upon replacement of the predicted dom1 of the passenger domain by a flexible amino acid sequence (Δd1) secretion of the EspC passenger proceeds with the same efficiency as wild-type EspC (wt). Furthermore, this example illustrates that ESAT6 can be efficiently secreted upon fusion to the EspC passenger at the position of the predicted domain d1 (Δd1/ESAT6). Proper secretion follows from the appearance of cleaved passenger domain (>) in the medium fraction (m) and cleaved, and cleaved translocator domain in the cell fraction (x) (FIG. 24 A). The presence of ESAT6 in the EspC(Δd1/ESAT6) passenger domain is confirmed by Western blotting using ESAT6 specific antibodies (FIG. 24 B). Molecular mass (kDa) markers are indicated at the left side of the panels.

Example 13

Secretion of Split Ag85B and ESAT6 (FIG. 25)

This example illustrates the simultaneous secretion of the amino acid stretches Ag85B[N'] and Ag85B[C'], roughly corresponding to the N' and C' terminal half of the mature region of the *Mycobacterium tuberculosis* antigen Ag85B, respectively. Secretion of the two moieties was achieved upon translational fusion of Ag85B[N'] to the Hbp passenger at the position of domain 1 and Ag85B[C'] at the position of domain 2 of the same Hbp passenger molecule ($85_{[N+C]}$). Alternatively, Ag85B[C'] was fused at the position of domain 1 and Ag85B[N'] at the position of domain 2 ($85_{[N+C]}$).

In addition, this example illustrates the simultaneous secretion of Ag85B[N'], Ag85B[C'] and the mycobacterial antigen ESAT6. This was achieved upon fusion of Ag85B[N'] at the position of domain 1, Ag85B[C'] at the position of domain 2 and insertion of ESAT6 into domain 4 of the same Hbp passenger molecule ($85_{[N+C]}$/E6). Alternatively, Ag85B[C'] was fused at the position of domain 1, Ag85B[N'] fused at the position of domain 2 and ESAT6 inserted into domain 4 ($85_{[C+N]}$/E6).

Expression, secretion and proteinase K accessibility of Hbp, Hbp(Δβ-cleav), Hbp-$Ag85B_{[N+C]}$, Hbp-$Ag85B_{[C+N]}$, Hbp-$Ag85B_{[N+C]}$/ESAT6, Hbp-$Ag85B_{[C+N]}$/ESAT6. (FIG. 25 A) *E. coli* TOP10F' cells harbouring the constructs cloned into the expression vector pEH3 or an empty vector (−) from overnight cultures were grown, induced and analyzed as described under Example 6. (FIG. 25 B) Cells as grown and induced under A were resuspended in 50 mM Tris-HCl, PH 7.4, containing 1 mM CaCl. Subsequently, samples were incubated at 37° C. for 1 hour with (+) or without (−) proteinase k (pk) (100 μg/ml). The reaction was stopped by addition of 0.1 mM phenylmethylsulfonyl fluoride (PMSF) and incubation on ice for 5 min. Samples were subjected to TCA precipitation before solubilization in SDS-PAGE sample buffer and analysis on Coomassie stained SDS-PAGE. Molecular mass (kDa) markers are indicated at the left side of the panels. Cleaved passengers (>) and translocator domains (β), the position of proteinase K (pk) is indicated.

Proper secretion follows from the appearance of cleaved passenger domain (>) and translocator domain (β) in the cell fraction (c), similar to wild-type Hbp (A). As a control, no cleaved passenger and translocator domain is observed for a non-cleavable, but translocation competent version of Hbp (Δβ). To confirm their extracellular location, sensitivity of the passengers towards proteinase K added to intact cells is shown (B).

Example 14

Simultaneous Secretion of Split Ag85B, ESAT6 and Rv2660 (FIG. 26)

This example illustrates the simultaneous secretion of Ag85B[N'], Ag85B[C'], ESAT6 and the Mycobacterial antigen Rv2660c when fused to a single Hbp passenger domain.

Secretion the moieties was achieved upon translational fusion of Ag85B[C'] to the Hbp passenger at the position of domain 1, fusion of Ag85B[N'] at the position of domain 2, insertion of ESAT6 into domain 4, and fusion of Rv2660c at the position of domain 5 ("85-E6-2660"). For comparison, the secretion of constructs only carrying Ag85B[C'] and Ag85B[N'] ("85") or Ag85B[C'], Ag85B[N'] and ESAT6 ("85-E6") were analyzed in parallel.

Expression and secretion of Hbp-Ag85B$_{[C+N]}$, Hbp-Ag85B$_{[C+N]}$/ESAT6 and Hbp-Ag85B$_{[C+N]}$/ESAT6/Rv2660c. *E. coli* MC1061 cells harbouring the constructs cloned into the expression vector pEH3 were grown and induced as described under Example 6.

Proper secretion follows from the appearance of cleaved passenger domain (>) and translocator domain (x) in the cell fraction (c) (FIG. 26). Molecular mass (kDa) markers are indicated at the left side of the panel.

Example 15

Simultaneous Display of Split Ag85B, ESAT6 and Rv2660c (FIG. 27)

This example illustrates the simultaneous display of Ag85B[N'], Ag85B[C'], ESAT6 and Rv2660c when fused to a single passenger domain of Hbp(Δβcleav), a non-cleavable, yet translocation competent version of Hbp. Display was achieved upon translational fusion of Ag85B[C'] to the Hbp passenger at the position of domain 1, fusion of Ag85B[N'] at the position of domain 2, insertion of ESAT6 into domain 4, and fusion of Rv2660c at the position of domain 5 (85-E6-2660). For comparison, the display of constructs only carrying Ag85B[C'] and Ag85B[N'] (85), or Ag85B[C'], Ag85B [N'] and ESAT6 (85-E6) were analyzed in parallel. Furthermore, display of Hbp(Δβcleav) (Δβ) was analyzed (FIG. 27 A).

Westen blotting using specific antibodies against Ag85B [C'], ESAT6 and Rv2660c was carried out to confirm the presence of these moieties in the respective passenger domains where appropriate (FIG. 27 B).

To confirm translocation of the respective passenger domains across the cell envelope, and their display at the cell surface, sensitivity of the passengers towards proteinase K added to intact cells is shown (FIG. 27 C).

In FIG. 27 molecular mass (kDa) markers are indicated at the left side of the panels. Non-cleaved pro-form Hbp species are indicated (*).

Expression and display of Hbp(Δβcleav), HbpD-Ag85B$_{[C+N]}$, HbpD-Ag85B$_{[C+N]}$/ESAT6 and HbpD-Ag85B$_{[C+N]}$/ESAT6/Rv2660c. (A) *E. coli* MC1061 cells harbouring the constructs cloned into the expression vector pEH3 were grown and induced as described under Example 6. Samples were withdrawn from the cultures 2 h after induction. Subsequently, cells were isolated by centrifugation, solubilized in SDS-PAGE sample buffer and analyzed by Coomassie stained SDS-PAGE. (B) Samples from A corresponding to 0.003 $OD_{660}$ units of cells were analyzed by Western blotting using either monoclonal antibodies directed against an epitope of Ag85B$_{[C]}$, monoclonal antibodies directed against ESAT6 or polyclonal antibodies directed against Rv2660c. (C) Cells as grown and induced under A were resuspended in 50 mM Tris-HCl, PH 7.4, containing 1 mM CaCl. Subsequently, samples were incubated at 0° C. for 30 min with (+) or without (−) proteinase k (pk)(100 μg/ml). The reaction was stopped by addition of 0.1 mM phenylmethylsulfonyl fluoride (PMSF) and incubation on ice for 5 min. Samples were subjected to TCA precipitation before solubilization in SDS-PAGE sample buffer and analysis on Coomassie stained SDS-PAGE.

Example 16

Simultaneous Secretion of Ag85B, ESAT6 and Rv2660c by an Attenuated *Salmonella* Strain (FIG. 28)

This example illustrates the simultaneous secretion of Ag85B[N'], Ag85B[C'], ESAT6 and the Mycobacterial antigen Rv2660c, when fused to a single Hbp passenger domain, by attenuated *Salmonella typhimurium*. Secretion the moieties was achieved upon translational fusion of Ag85B[C'] to the Hbp passenger at the position of domain 1, fusion of Ag85B[N'] at the position of domain 2, insertion of ESAT6 into domain 4, and fusion of Rv2660c at the position of domain 5 (85$_{[C+N]}$-E6-2660). Proper secretion follows from the appearance of cleaved passenger domain (>) in the medium fraction (m) (FIG. 28 A).

Westen blotting using specific antibodies against Ag85B [C'], ESAT6 and Rv2660c was carried out to confirm the presence of these moieties in the secreted passenger domain. Furthermore, Western blotting using an antiserum against the Hbp translocator domain (αbarrel) confirmed the occurrence of cleaved translocator domain in the cells (FIG. 28 B).

Expression and secretion of Hbp-Ag85B$_{[C+N]}$-ESAT6-Rv2660c by attenuated *Salmonella typhimurium*. (A) *Salmonella typhimurium* strain SL3261 (Hoiseth and Stocker 1981 Nature 291: 281-282) and a derivative carrying a single copy of the gene encoding Hbp-Ag85B$_{[C+N]}$-ESAT6-Rv2660c on the genome under control of a constitutive lacUV5 promoter were grown overnight to saturation in LB medium at 37° C. For construction of *Salmonella* strains see Example 21. Next morning, the cells were subcultured in fresh medium and their growth was continued. Two hours after subculturing, samples were collected from the cultures and cells (c) and spent medium (m) were separated by low speed centrifugation. Cells were directly solubilized in SDS-PAGE sample buffer whereas medium samples were subjected to TCA precipitation first. Samples corresponding to 0.03 $OD_{660}$ units of cells were analyzed by SDS-PAGE and Coomassie staining. (B) Samples from A corresponding to 0.003 $OD_{660}$ units of cells were analyzed by Western blotting using either monoclonal antibodies directed against an epitope of Ag85B$_{[C]}$, monoclonal antibodies directed against ESAT6, polyclonal antibodies directed against Rv2660c, or polyclonal antibodies directed against the Hbp translocator domain.

A background band of unknown identity (*) is indicated. Molecular mass (kDa) markers are indicated at the left side of the panels.

Example 17

Simultaneous Display of Ag85B, ESAT6 and Rv2660c by an Attenuated *Salmonella* Strain (FIG. 29)

This example illustrates the expression and simultaneous display of Ag85B[N'], Ag85B[C'], ESAT6 and Rv2660c at the cell surface of attenuated *Salmonella typhimurium*, when fused to a single Hbp passenger domain of passenger domain of Hbp(Δβcleav), a non-cleavable, yet translocation competent version of Hbp (HbpD-Ag858$_{[C+N]}$-ESAT6-Rv2660c). Also shown is the surface display of a single ESAT6 unit using the same strategy (HbpD-ESAT6).

Proper expression of the constructs follows from analysis by SDS-PAGE and Coomassie staining showing the appearance of protein bands with a molecular weight corresponding to the calculated molecular weight of HbpD-Ag85B$_{[C+N]}$-

ESAT6-Rv2660c and HbpD-ESAT6, respectively (*). As a control, these bands are not present in non-expressing control cells (−).

To confirm translocation of the respective passenger domains across the cell envelope and display at the cell surface, their sensitivity towards proteinase K (pk) added to intact cells is shown.

Expression and display of HbpD-Ag85B$_{[C+N]}$-ESAT6-Rv2660c and HbpD-ESAT6 on the cell surface of attenuated *Salmonella typhimurium*. *Salmonella typhimurium* strain SL3261 (Hoiseth and Stocker 1981 Nature 291: 281-282) (−) and derivative carrying either a single copy of the gene encoding HbpD-Ag85B$_{[C+N]}$-ESAT6-Rv2660c or the gene encoding HbpD-ESAT6 on the genome under control of a constitutive lacUV5 promoter, were grown overnight to saturation in LB medium at 37° C. For construction of *Salmonella* strains see Example 21. Next morning, the cells were subcultured in fresh medium and their growth was continued. Two hours and 30 min after subculturing, samples were collected from the cultures and cells were resuspended in 50 mM Tris-HCl, PH 7.4, containing 1 mM CaCl. Subsequently, samples were incubated at 37° C. for 1 hour with (+) or without (−) proteinase k (pk)(100 µg/ml), The reaction was stopped by addition of 0.1 mM phenylmethylsulfonyl fluoride (PMSF) and incubation on ice for 5 min. Samples were subjected to TCA precipitation, solubilized in SDS-PAGE sample buffer and analyzed on Coomassie stained SDS-PAGE. The non-processed pro-forms of the constructs (*), comprising both a passenger and translocator domain, are indicated. Molecular weight markers (kDa) are displayed at the right hand side of the panels.

Example 18

Simultaneous Display of Split Ag85B, ESAT6 and Rv2660c on Outer Membrane Vesicles (FIG. 30A-D)

This sample illustrates the simultaneous display of Ag85B [C'], Ag85B[N'] and ESAT6 on the surface of bacterial outer membrane vesicles (OMVs) upon fusion to a single passenger domain of Hbp(Δβcleav), a non-cleavable, yet translocation competent version of Hbp (85B-E6-2660). In addition, the combined display of Ag85B[C'], Ag85B[N'] and ESAT6 (85B-E6), as well as a single ESAT6 unit (Δd1-E6) is shown. As a control, the display of HbpD(Δd1) not carying a heterologous partner (Δd1) was analyzed. To achieve display on OMVs, the fusion proteins were expressed in an *E. coli* strain carrying mutations in the tol-pal genes inducing a hyper-vesiculating phenotype.

Figure 30:
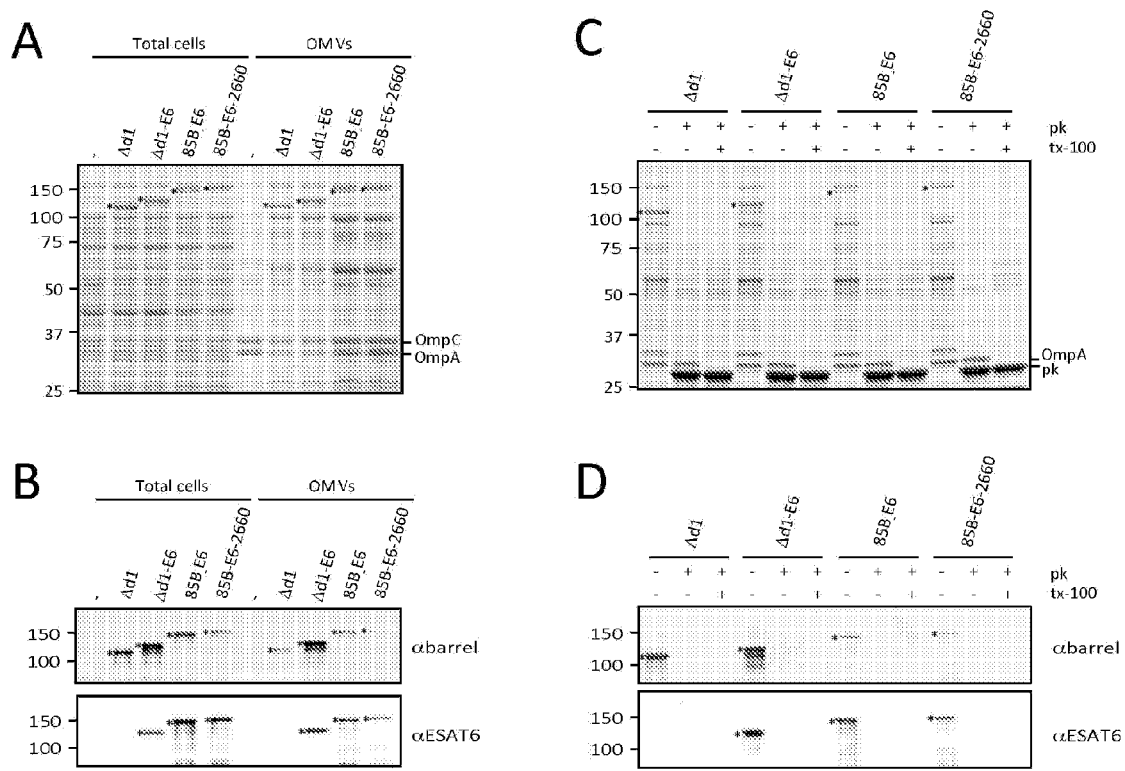

Localization of the fusion proteins in OMVs is shown by their colocalization with outer membrane porin proteins OmpA and OmpC in OMV isolates derived from filtrated and, hence, cell-free culture medium fractions (FIGS. 30A and B). Successful display of the fusion proteins at the surface of OMVs is shown by their sensitivity towards proteinase K added to the OMVs externally (FIGS. 30C and D). To confirm the integrity of the OMVs, it is shown that the proteinase K sensitive intracellular domain of OmpA is not accessible, unless the OMVs are solublized using the detergent triton x-100 (tx-100).

Expression and display of HbpD(Δd1), HbpD(Δd1)-ESAT6, HbpD-Ag85B$_{[C+N]}$-ESAT6 and Ag85B$_{[C+N]}$-ESAT6-Rv2660c on OMVs. (A) *E. coli* JC8031 cells (Barnadac et al 1998 Journal of Bacteriology 180: 4872-4878) harbouring the constructs cloned into the expression vector pEH3 or an empty vector (−) from overnight cultures were subcultured in fresh medium and their growth was continued. When cultures reached early log phase (OD$_{660}$≈0.2), expression of Hbp(derivatives) was induced with 1 mM of IPTG. Three hours after induction 50 ml culture samples were centrifuged (5000 rpm, 4° C., 15 min) to separate the cells from the medium. Cells (Total cells) were solubilized in SDS-PAGE sample buffer whereas the culture medium was subjected to centrifugation once more (5000 rpm, 4° C., 15 min). The resulting supernatant was filtered through 0.2 µm-pore-size filters and subjected to high-speed centrifugation (45,000 rpm, 4° C., 1 h) using a Kontron TFT 70.38 rotor. The pellet fraction, containing the OMVs, was resuspended in PBS. A sample corresponding to 1 OD660 unit of cells was solubilized in SDS-PAGE sample buffer and analyzed by Coomassie stained SDS-PAGE in parallel to 0.02 OD660 units of Total cells. The outer membrane proteins OmpA and OmpC, the identity of which was confirmed by Mass spec analysis, have been indicated at the left side of the panel. (B) To confirm the identity of the fusion proteins, samples prepared under A were analyzed by Western blotting using a polyclonal antiserum against the Hbp translocator domain (αbarrel) and monoclonal antibodies against ESAT6. (C) Proteinase K treatment of OMVs. OMVs isolated under A were resuspended in 50 mM Tris-HCl, PH 7.4, containing 1 mM CaCl. Samples were split into three equal aliquots, which were incubated with (+) or without (−) Proteinase K (pk) (100 µg/ml) as indicated. Prior to addition of proteinase k, triton X-100 (tx-100) (1%) was added to one of the aliquots. All aliquots were incubated at 37° C. for 30 min, after which the reaction was stopped by addition of 0.1 mM phenylmethylsulfonyl fluoride (PMSF) and incubation on ice for 5 min. Samples were subjected to TCA precipitation, solubilized in SDS-PAGE sample buffer. Samples corresponding to 1 OD660 unit of cells were by Coomassie stained SDS-PAGE. (D) To confirm the identity of the fusion proteins, samples prepared under C were analyzed by Western blotting using a polyclonal antiserum against the Hbp translocator domain (αbarrel) and monoclonal antibodies against ESAT6. The non-processed pro-forms of the constructs (*), comprising both a passenger and translocator domain, are indicated. Molecular weight markers (kDa) are displayed at the right hand side of the panels.

Example 19

Figure 31:
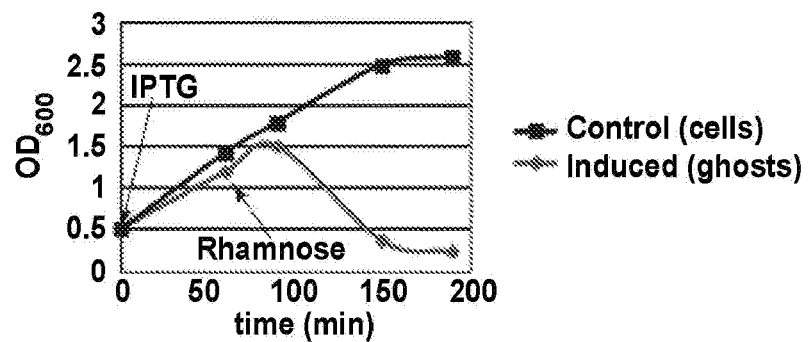
Figure 31:
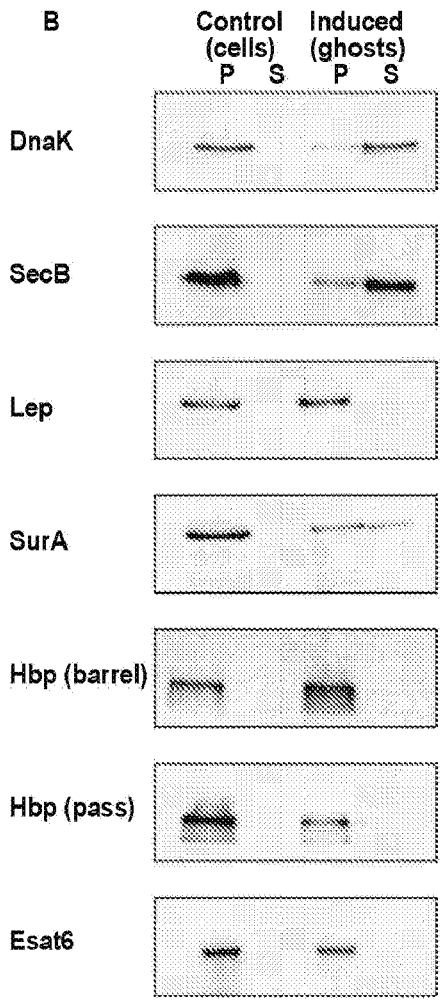
Figure 31:
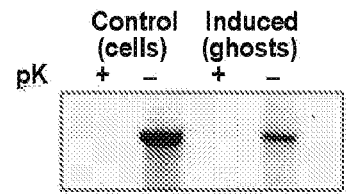

Display of Split Ag85B and ESAT6 on Ghosts (FIG. 31A-C)

In the present Example 19 plasmid pLargeRhaLysisE was used to turn *E. coli* cells into ghosts using the herein described methodology. The construction of pLargeRhaLysisE is described in Example 20.

This sample illustrates the simultaneous display of Ag85B$_{[C]}$, Ag85B$_{[N]}$ and ESAT6 on the surface of bacterial ghosts upon fusion to a single passenger domain of Hbp (Δβcleav). To achieve surface display on ghosts, HbpD-Ag85B$_{[C+N]}$-ESAT6 was expressed in *E. coli* cells transformed with a plasmid that carries the gene encoding the bacteriophage phiX174 lysis protein E under control of an inducible promoter. Following expression of HbpD-Ag85B$_{[C+N]}$-ESAT6, expression of the lysis protein E was induced, leading to the release of the cellular cytoplasmic content into the culture medium. This resulted in the emergence of 'empty' bacterial cell envelopes (ghosts) displaying HbpD-Ag85B$_{[C+N]}$-ESAT6 at the surface.

Succesful lyis protein E mediated ghost formation is shown by a drop in apparent cell density (OD600) upon lyis protein E expression (FIG. 31A). Furthermore, it is shown that cytoplasmic marker proteins (SecB, DnaK) are released into the medium upon expression of lysis protein E and, hence, end up in the supernatant fraction after centrifugation. In contrast, a periplasmic marker protein (SurA) and an integral membrane protein (Lep) (mainly) localize to the centrifugation pellet containing the bacterial cell envelopes (ghosts) (FIG. 31B). Correct localization of HbpD-Ag85B$_{[C+N]}$-ESAT6 in the ghosts is shown by its colocalization with Lep in the pellet fraction (FIG. 31B). Successful display of HbpD-Ag85B$_{[C+N]}$-ESAT6 at the surface of ghosts and control cells is shown by its sensitivity towards proteinase K added to the ghosts/cells externally (FIG. 31C).

Expression and display of HbpD-Ag85B$_{[C+N]}$-ESAT6 and the subsequent formation of ghosts. (A) *E. coli* MC4100 cells co-transformed with (i) a pEH3$_{(p15a)}$-HbpD-Ag85B$_{[C+N]}$-ESAT6, and (ii) pLargeRhaLysisE, carrying the gene encoding lysis protein E from bacteriophage phiX174 under control of an rhamnose inducible promoter, were grown in LB medium at 30° C. When the culture reached an OD600 of 0.5, 0.4 mM of IPTG was added to induce the expression of HbpD-Ag85B$_{[C+N]}$-ESAT6 and the culture was split. One hour after addition of IPTG, 0.2% rhamnose was added to one half of the original culture to induce the expression of lysis protein E, whereas the other half of the culture was used as a control. The OD600 of the cultures was monitored over time. (B) Three hours after IPTG induction, the control cells (non-induced culture) and ghosts (induced culture) grown under A were isolated by centrifugation. The supernatant containing the culture medium was isolated and its protein content was TCA precipitated. Cell/ghost pellets (P; cell/ghost pellet) and TCA precipitated material (S; supernatant) were then solubilized in SDS-PAGE sample buffer and analyzed by SDS-PAGE and Western blotting. The presence of HbpD-Ag85B$_{[C+N]}$-ESAT6 was detected using polyclonal antibodies directed against the Hbp passenger (pass.) and translocator domain (barrel), and monoclonal antibodies against ESAT6. The formation of ghosts was monitored using polyclonal antibodies against the cytoplasmic proteins DnaK and SecB, the periplasmic protein SurA and the integral membrane protein Lep. (C) Proteinase K treatment of control cells and ghosts. Part of the cells and ghosts isolated under 8 were resuspended in 50 mM Tris-HCl, PH 7.4, containing 1 mM CaCl. Proteinase K (100 μg/ml) was added to half of each sample (+) whereas the other half was left untreated (−). Samples were incubated at 37° C. for 1 h, after which the reaction was stopped by addition of 0.1 mM phenylmethylsulfonyl fluoride (PMSF) and incubation on ice for 5 min. Samples were subjected to TCA precipitation, solubilized in SDS-PAGE sample buffer and analyzed by Western blotting using an antiserum against the Hbp passenger domain.

Example 20

Figure 32:
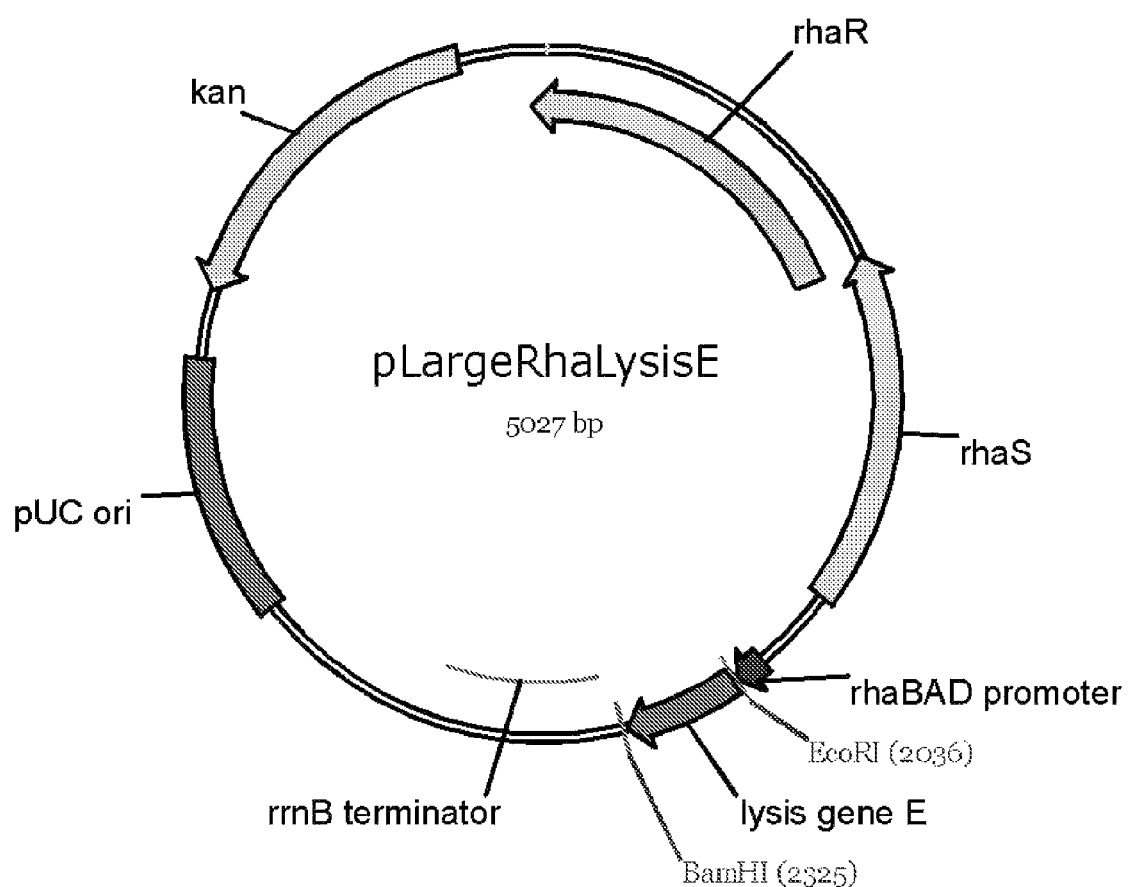

The following example relates to construction of plasmid pLargeRhaLysisE. FIG. 32 shows a plasmid map of pLargeRhaLysisE used in Example 20. Table 3 and Table 4 below show, respectively, the primer sequences and the constructs used in Example 20.

Plasmid pLargeRhaLysisE carries the gene encoding lysis protein E from bacteriophage phiX174 under control of a rhamnose inducible rhaBAD promoter. To construct pLargeRhaLysisE, plasmid pLarge was constructed first, which is based on pSB3398 (Wagner et al 2010 Proc Natl Acad Sci USA 107:17745-17750) and pRha67K.

Plasmid pRha67K is a derivative of pRha67 (Giacalone et al. 2006 BioTechniques 40: 355-364) where the gene encoding the ampicillin marker is replaced from the start to the stop codon by the gene encoding the kanamycin marker from pET28(a+) (EMD Biosciences) using the USER cloning method (Bitinaite and Nichols 2009 Curr Protoc Mol Biol Chapter 3:Unit 3.21; Nørholm 2010 BMC Biotechnol 10: 21). The gene encoding the kanamycin resistance marker of pET28(a+) was amplified using pET28(a+) as a template and the deoxyuracil (u) containing primers kanR and kanF. DNA encoding pRha67 without the gene encoding the ampicillin marker was amplified using the deoxyuracil containing primers pRhakanF and pRhakanR. The PfuX7 polymerase was used to amplify DNA using deoxyuracil containing primers (Nørholm 2010 BMC Biotechnol 10: 21). Subsequently, USER Enzyme (New England Biolabs) was used according to the instructions of the manufacturer for the construction of pRha67K.

Plasmid pLarge is a derivative of pRha67K where the rhamnose promoter (including regulatory elements), multiple cloning site and terminator are replaced by the ones from pSB3398 (VVagner et al 2010 Proc Natl Acad Sci USA 107:17745-17750) using the USER cloning method (Bitinaite and Nichols 2009 Curr Protoc Mol Biol Chapter 3:Unit 3.21; Nørholm 2010 BMC Biotechnol 10: 21). The regulatory elements (rhaR, rhaS PrhaBAD), and the multiple cloning site and transcriptional terminator rrnB were amplified using pSB3398 as a template and the deoxyuracil containing primers pSB3398 forward and pSB3398 reverse. pRha67K was used as a template to amplify the part of pRha67K covering the kanamycin resistance marker (including its promoter and terminator) and origin of replication. The deoxyuracil containing primers used were 67kF and pRhaR. The PfuX7 polymerase was used to amplify the DNA and, subsequently, USER Enzyme (New England Biolabs) was used according to the instructions of the manufacturer to construct pLarge.

To construct pLargeRhaLysisE, a synthetic DNA sequence encoding lysis protein E from bacteriophage phiX174 was obtained from MWG. The synthetic DNA fragment possessed EcoRI and BamHI sites at the 5' and 3' side of the coding sequence, respectively. This allowed cloning into the EcoRI and BamHI sites of pLarge, yielding pLargeRhaLysisE.

TABLE 3

Primers used in Example 20

| Name | SEQ ID NO | Sequence (5' à 3') |
|---|---|---|
| kanR | 124 | agaaaaacucatcgagcatcaaatg |
| kanF | 125 | atgagccauattcaacgggaaac |
| pRhakanF | 126 | agtttttcuaactgtcagaccaagtttactc |
| pRhakanR | 127 | atggctcauactcttccttttcaatattattgaagc |
| pSB3398 fw | 128 | atctttcugcgaattgagatgac |
| pSB3398 rev | 129 | aagcctaguctcatgagcgg |
| 67kF | 130 | actaggctugtaatcatggtcatagctgtttc |
| pRhaR | 131 | agaaagauagacgaaagggcctcgtgatac |

NB: In Table 3 uracils are indicated with u.

TABLE 4

Constructs used in Example 20

| Name | Protein SEQ ID NO | DNA SEQ ID NO |
|---|---|---|
| lysis protein E | 132 | 133 |

Example 21

Figure 33:
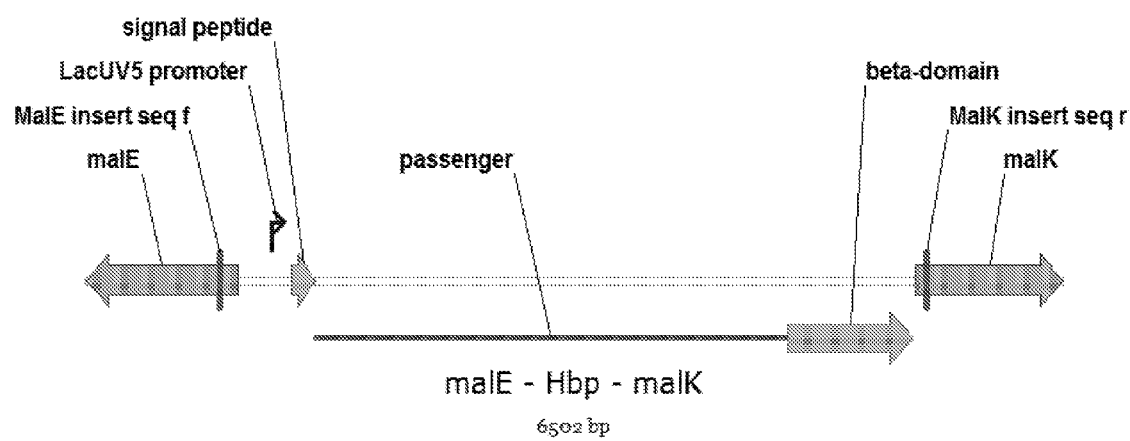
Figure 34:
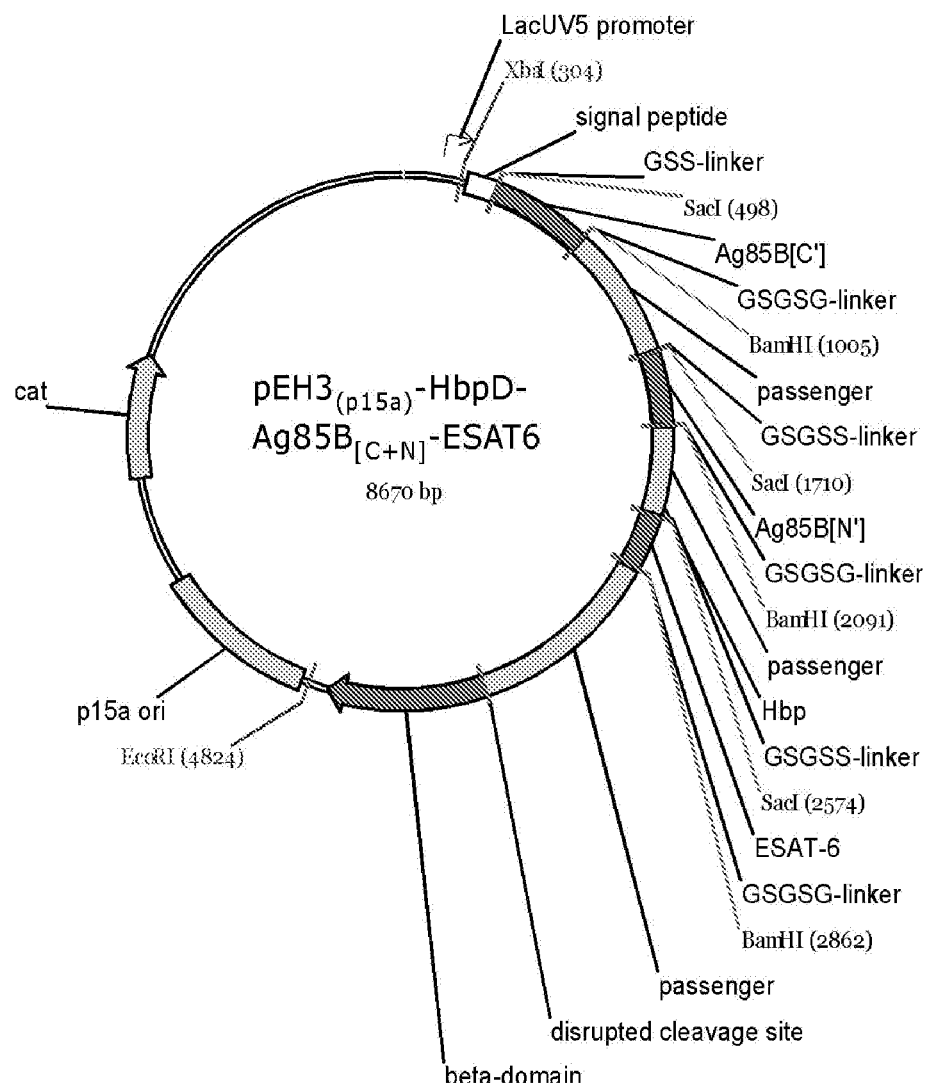
FIG. 34 shows a map of a plasmid used in the examples.

The following example 21 relates to construction of *Salmonella* strains. FIG. 33 shows a schematic representation of the location of hbp mutant insertions into the *Salmonella typhimurium* SL3261 chromosome. Table 5 below shows the primer sequences used in Example 21.

*Salmonella typhimurium* strains carrying a single copy of either of the genes encoding Hbp-Ag85B(C+N)-ESAT6-Rv2660c, HbpD-ESAT6 or HbpD-Ag85B(C+N)-ESAT6-Rv2660c on the chromosome, were constructed as follows. The concerning hbp mutant genes were inserted into the chromosome of *S. typhimurium* by allelic exchange through double cross-over homologues recombination (Kaniga et al 1991 Gene 109: 137-141), replacing the malE and malK promotor regions. Briefly, the hbp mutants including the lacUV5 promoter region were amplified by PCR using pHbp-Ag85B(C+N)-ESAT6-Rv2660c, pHbpD-ESAT6 or pHbpD-Ag85B(C+N)-ESAT6-Rv2660c as a template, respectively. The primers used were lacUV5_ScaI_f and pEH3Hbpbeta_ScaI_r. The PCR products were digested with ScaI and cloned into a SmaI-cut pSB890-derived suicide vector (Palmer et al 1998 Molecular Microbiology 27: 953-965), just in between 1000 bp homology regions to malE and malK (FIG. 33).

The resulting hbp mutant-suicide vectors were transformed into the *E. coli* donor strain SM10λ pir (Miller and Mekalanos 1998 Journal of Bacteriology 170: 2575-2583). SM10λ pirwas mated over night on plate with the *S. thypimurium* recipient strain SL3261 (Hoiseth and Stocker 1981 Nature 291: 281-282). Tetracyclin resistant *S. thypimurium* transconjugants were selected on plate.

Resolution of merodiploids and replacement of the wild-type locus with an hbp mutant gene were achieved by selecting for resistance of the *Salmonella* mutants to sucrose (Kaniga et al 1991 Gene 109: 137-141). Positive clones were identified by PCR of the intergenic region between malE and malK using primers malE_insert_seq and malK_insert_seq, and sequencing of the introduced allele.

TABLE 5

| Primers used in Example 21 | | |
|---|---|---|
| Name | SEQ ID NO | Sequence (5' à 3') |
| lacUV5_ScaI_f | 134 | GCGC AGTACT TTG CGC CAT TCT ATG GTG TC |
| pEH3Hbpbeta_ScaI_r | 135 | GCGCAGTACTCACAGCATCAGA ATGAATAACG |
| malE_insert_seq | 136 | TAT AAC CCT TGT CGC CGT TG |
| malK_insert_seq | 137 | ACG CAG CAA GGT CGA TTT AC |

SEQUENCE LISTING (137 sequences)

SEQ ID NO: 1 - protein, 1377 aa, Escherichia coli
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 2 - protein, 1377 aa, Escherichia coli
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVGSLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 3 - protein, 445 aa, Escherichia coli
MNRIYSLRYSAVARGFIAVSEFARKCVHKSVRRLCFPVLLLIPVLFSAGSLAGSSCGSGSGADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 4 - protein, 1131 aa, Escherichia coli
MNRIYSLRYSAVARGFIAVSEFARKCVHKSVRRLCFPVLLLIPVLFSAGSLAGSSCGSGSGNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 5 - protein, 1131 aa, Escherichia coli
MNRIYSLRYSAVARGFIAVSEFARKCVHKSVRRLCFPVLLLIPVLFSAGSLAGSSCGSGSGNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVGSLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 6 - protein, 1314 aa, Escherichia coli
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYAGSGSSAGSGSGNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 7 - protein, 1314 aa, Escherichia coli
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYAGSGSSAGSGSGNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVGSLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 8 - protein, 1350 aa, Escherichia coli
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGSGSSAGSGSGNRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 9 - protein, 1358 aa, Escherichia coli
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDGSGSSAGSGSGSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 10 - protein, 1366 aa, Escherichia coli
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGSGSSAGSGSGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 11 - protein, 1383 aa, Escherichia coli
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVAGSGSSAGSGSGKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 12 - protein, 539 aa, Artificial Sequence
  Escherishia coli/Mycobacterium tuberculosis
MNRIYSLRYSAVARGFIAVSEFARKCVHKSVRRLCFPVLLLIPVLFSAGSLAGSSMTEQQWNFAGIEAAASAIQGNVTSIHSLLDEGKQSLTKLAAAWGGSGSEAYQGVQQKWDATATELNNALQNLARTISEAGQAMASTEGNVTGMFAGSGSGADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 13 - protein, 1225 aa, Artificial Sequence
  Escherishia coli/Mycobacterium tuberculosis
MNRIYSLRYSAVARGFIAVSEFARKCVHKSVRRLCFPVLLLIPVLFSAGSLAGSSMTEQQWNFAGIEAAASAIQGNVTSIHSLLDEGKQSLTKLAAAWGGSGSEAYQGVQQKWDATATELNNALQNLARTISEAGQAMASTEGNVTGMFAGSGSGNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 14 - protein, 1225 aa, Artificial Sequence
  Escherishia coli/Mycobacterium tuberculosis
MNRIYSLRYSAVARGFIAVSEFARKCVHKSVRRLCFPVLLLIPVLFSAGSLAGSSMTEQQWNFAGIEAAASAIQGNVTSIHSLLDEGKQSLTKLAAAWGGSGSEAYQGVQQKWDATATELNNALQNLARTISEAGQAMASTEGNVTGMFAGSGSGNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVGSLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 15 - protein, 1408 aa, Artificial Sequence
  Escherishia coli/Mycobacterium tuberculosis
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYAGSGSSMTEQQWNFAGIEAAASAIQGNVTSIHSLLDEGKQSLTKLAAAWGGSGSEAYQGVQQKWDATATELNNALQNLARTISEAGQAMASTEGNVTGMFAGSGSGNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 16 - protein, 1408 aa, Artificial Sequence
  Escherishia coli/Mycobacterium tuberculosis
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYAGSGSSMTEQQWNFAGIEAAASAIQGNVTSIHSLLDEGKQSLTKLAAAWGGSGSEAYQGVQQKWDATATELNNALQNLARTISEAGQAMASTEGNVTGMFAGSGSGNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVGSLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 17 - protein, 1444 aa, Artificial Sequence
  Escherishia coli/Mycobacterium tuberculosis
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGSGSSMTEQQWNFAGIEAAASAIQGNVTSIHSLLDEGKQSLTKLAAAWGGSGSEAYQGVQQKWDATATELNNALQNLARTISEAGQAMASTEGNVTGMFAGSGSGNRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 18 - protein, 1452 aa, Artificial Sequence
  Escherishia coli/Mycobacterium tuberculosis
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDGSGSSMTEQQWNFAGIEAAASAIQGNVTSIHSLLDEGKQSLTKLAAAWGGSGSEAYQGVQQKWDATATELNNALQNLARTISEAGQAMASTEGNVTGMFAGSGSGSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 19 - protein, 1460 aa, Artificial Sequence
  Escherishia coli/Mycobacterium tuberculosis
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGSGSSMTEQQWNFAGIEAAASAIQGNVTSIHSLLDEGKQSLTKLAAAWGGSGSEAYQGVQQKWDATATELNNALQNLARTISEAGQAMASTEGNVTGMFAGSGSGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 20 - protein, 1477 aa, Artificial Sequence
  Escherishia coli/Mycobacterium tuberculosis
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVAGSGSSMTEQQWNFAGIEAAASAIQGNVTSIHSLLDEGKQSLTKLAAAWGGSGSEAYQGVQQKWDATATELNNALQNLARTISEAGQAMASTEGNVTGMFAGSGSGKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 21 - protein, 1482 aa, Artificial Sequence
  Escherishia coli/Mycobacterium tuberculosis
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGGSGSSMTEQQWNFAGIEAAASAIQGNVTSIHSLLDEGKQSLTKLAAAWGGSGSEAYQGVQQKWDATATELNNALQNLARTISEAGQAMASTEGNVTGMFAGSGSGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 22 - protein, 1424 aa, Artificial Sequence
  Escherishia coli/Mycobacterium tuberculosis
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGSGSSVIAGVDQALAATGQASQRAAGASGGVTVGVGVGTEQRNLSVVAPSQFTFSSRSPDFVDETAGQSWCAILGLNQFHGSGSGNRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 23 - protein, 1432 aa, Artificial Sequence
  Escherishia coli/Mycobacterium tuberculosis
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDGSGSSVIAGVDQALAATGQASQRAAGASGGVTVGVGVGTEQRNLSVVAPSQFTFSSRSPDFVDETAGQSWCAILGLNQFHGSGSGSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 24 - protein, 1440 aa, Artificial Sequence
  Escherishia coli/Mycobacterium tuberculosis
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGSGSSVIAGVDQALAATGQASQRAAGASGGVTVGVGVGTEQRNLSVVAPSQFTFSSRSPDFVDETAGQSWCAILGLNQFHGSGSGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 25 - protein, 1226 aa, Artificial Sequence
  Escherishia coli/Mycobacterium tuberculosis
MNRIYSLRYSAVARGFIAVSEFARKCVHKSVRRLCFPVLLLIPVLFSAGSLAGSSMSQIMYNYPAMLGHAGDMAGYAGTLQSLGAEIAVEQAALQSAWQGDTGITYQAWQAQWNQAMEDLVRAYHAMSSTHEANTMAMMARDTAEAAKWGGGSGSGNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 26 - protein, 1409 aa, Artificial Sequence
  Escherishia coli/Mycobacterium tuberculosis
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYAGSGSSMSQIMYNYPAMMAHAGDMAGYAGTLQSLGADIASEQAVLSSAWQGDTGITYQGWQTQWNQALEDLVRAYQSMSGTHESNTMAMLARDGAEAAKWGGGSGSGNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 27 - protein, 1183 aa, Artificial Sequence
  Escherishia coli/Mycobacterium tuberculosis
MNRIYSLRYSAVARGFIAVSEFARKCVHKSVRRLCFPVLLLIPVLFSAGSLAGSSNSDSESPLSHDGYSLHDGVSMYIEALDKYASNSVVGYIGERSQYRDLKWWELRGSGSGNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 28 - protein, 1360 aa, Artificial Sequence
  Escherishia coli/Mycobacterium tuberculosis
MNRIYSLRYSAVARGFIAVSEFARKCVHKSVRRLCFPVLLLIPVLFSAGSLAGSSFSRPGLPVEYLQVPSPSMGRDIKVQFQSGGNNSPAVYLLDGLRAQDDYNGWDINTPAFEWYYQSGLSIVMPVGGQSSFYSDWYSPACGKAGCQTYKWETFLTSELPQWLSANRAVKPTGSAAIGLSGSGSGNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYAGSGSSTGSAAIGLSMAGSSAMILAAYHPQQFIYAGSLSALLDPSQGMGPSLIGLAMGDAGGYKAADMWGPSSDPAWERNDPTQQIPKLVANNTRLWVYCGNGTPNELGGANIPAEFLENFVRSSNLKFQDAYNAAGGHNAVFNFPPNGTHSWEYWGAQLNAMKGDLQSSLGAGGSGSGNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 29 - protein, 1360 aa, Artificial Sequence
  Escherishia coli/Mycobacterium tuberculosis
MNRIYSLRYSAVARGFIAVSEFARKCVHKSVRRLCFPVLLLIPVLFSAGSLAGSSFSRPGLPVEYLQVPSPSMGRDIKVQFQSGGNNSPAVYLLDGLRAQDDYNGWDINTPAFEWYYQSGLSIVMPVGGQSSFYSDWYSPACGKAGCQTYKWETFLTSELPQWLSANRAVKPTGSAAIGLSGSGSGNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYAGSGSSTGSAAIGLSMAGSSAMILAAYHPQQFIYAGSLSALLDPSQGMGPSLIGLAMGDAGGYKAADMWGPSSDPAWERNDPTQQIPKLVANNTRLWVYCGNGTPNELGGANIPAEFLENFVRSSNLKFQDAYNAAGGHNAVFNFPPNGTHSWEYWGAQLNAMKGDLQSSLGAGGSGSGNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVGSLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 30 - protein, 1360 aa, Artificial Sequence
  Escherishia coli/Mycobacterium tuberculosis
MNRIYSLRYSAVARGFIAVSEFARKCVHKSVRRLCFPVLLLIPVLFSAGSLAGSSTGSAAIGLSMAGSSAMILAAYHPQQFIYAGSLSALLDPSQGMGPSLIGLAMGDAGGYKAADMWGPSSDPAWERNDPTQQIPKLVANNTRLWVYCGNGTPNELGGANIPAEFLENFVRSSNLKFQDAYNAAGGHNAVFNFPPNGTHSWEYWGAQLNAMKGDLQSSLGAGGSGSGNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYAGSGSSFSRPGLPVEYLQVPSPSMGRDIKVQFQSGGNNSPAVYLLDGLRAQDDYNGWDINTPAFEWYYQSGLSIVMPVGGQSSFYSDWYSPACGKAGCQTYKWETFLTSELPQWLSANRAVKPTGSAAIGLSGSGSGNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 31 - protein, 1360 aa, Artificial Sequence
  Escherishia coli/Mycobacterium tuberculosis
MNRIYSLRYSAVARGFIAVSEFARKCVHKSVRRLCFPVLLLIPVLFSAGSLAGSSTGSAAIGLSMAGSSAMILAAYHPQQFIYAGSLSALLDPSQGMGPSLIGLAMGDAGGYKAADMWGPSSDPAWERNDPTQQIPKLVANNTRLWVYCGNGTPNELGGANIPAEFLENFVRSSNLKFQDAYNAAGGHNAVFNFPPNGTHSWEYWGAQLNAMKGDLQSSLGAGGSGSGNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYAGSGSSFSRPGLPVEYLQVPSPSMGRDIKVQFQSGGNNSPAVYLLDGLRAQDDYNGWDINTPAFEWYYQSGLSIVMPVGGQSSFYSDWYSPACGKAGCQTYKWETFLTSELPQWLSANRAVKPTGSAAIGLSGSGSGNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVGSLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 32 - protein, 1460 aa, Artificial Sequence
  Escherishia coli/Mycobacterium tuberculosis
MNRIYSLRYSAVARGFIAVSEFARKCVHKSVRRLCFPVLLLIPVLFSAGSLAGSSTGSAAIGLSMAGSSAMILAAYHPQQFIYAGSLSALLDPSQGMGPSLIGLAMGDAGGYKAADMWGPSSDPAWERNDPTQQIPKLVANNTRLWVYCGNGTPNELGGANIPAEFLENFVRSSNLKFQDAYNAAGGHNAVFNFPPNGTHSWEYWGAQLNAMKGDLQSSLGAGGSGSGNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYAGSGSSFSRPGLPVEYLQVPSPSMGRDIKVQFQSGGNNSPAVYLLDGLRAQDDYNGWDINTPAFEWYYQSGLSIVMPVGGQSSFYSDWYSPACGKAGCQTYKWETFLTSELPQWLSANRAVKPTGSAAIGLSGSGSGNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVAGSGSSMTEQQWNFAGIEAAASAIQGNVTSIHSLLDEGKQSLTKLAAAWGGSGSEAYQGVQQKWDATATELNNALQNLARTISEAGQAMASTEGNVTGMFAGSGSGKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 33 - protein, 1460 aa, Artificial Sequence
  Escherishia coli/Mycobacterium tuberculosis
MNRIYSLRYSAVARGFIAVSEFARKCVHKSVRRLCFPVLLLIPVLFSAGSLAGSSTGSAAIGLSMAGSSAMILAAYHPQQFIYAGSLSALLDPSQGMGPSLIGLAMGDAGGYKAADMWGPSSDPAWERNDPTQQIPKLVANNTRLWVYCGNGTPNELGGANIPAEFLENFVRSSNLKFQDAYNAAGGHNAVFNFPPNGTHSWEYWGAQLNAMKGDLQSSLGAGGSGSGNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYAGSGSSFSRPGLPVEYLQVPSPSMGRDIKVQFQSGGNNSPAVYLLDGLRAQDDYNGWDINTPAFEWYYQSGLSIVMPVGGQSSFYSDWYSPACGKAGCQTYKWETFLTSELPQWLSANRAVKPTGSAAIGLSGSGSGNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVAGSGSSMTEQQWNFAGIEAAASAIQGNVTSIHSLLDEGKQSLTKLAAAWGGSGSEAYQGVQQKWDATATELNNALQNLARTISEAGQAMASTEGNVTGMFAGSGSGKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVGSLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 34 - protein, 1523 aa, Artificial Sequence
  Escherishia coli/Mycobacterium tuberculosis
MNRIYSLRYSAVARGFIAVSEFARKCVHKSVRRLCFPVLLLIPVLFSAGSLAGSSTGSAAIGLSMAGSSAMILAAYHPQQFIYAGSLSALLDPSQGMGPSLIGLAMGDAGGYKAADMWGPSSDPAWERNDPTQQIPKLVANNTRLWVYCGNGTPNELGGANIPAEFLENFVRSSNLKFQDAYNAAGGHNAVFNFPPNGTHSWEYWGAQLNAMKGDLQSSLGAGGSGSGNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYAGSGSSFSRPGLPVEYLQVPSPSMGRDIKVQFQSGGNNSPAVYLLDGLRAQDDYNGWDINTPAFEWYYQSGLSIVMPVGGQSSFYSDWYSPACGKAGCQTYKWETFLTSELPQWLSANRAVKPTGSAAIGLSGSGSGNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVAGSGSSMTEQQWNFAGIEAAASAIQGNVTSIHSLLDEGKQSLTKLAAAWGGSGSEAYQGVQQKWDATATELNNALQNLARTISEAGQAMASTEGNVTGMFAGSGSGKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGSGSSVIAGVDQALAATGQASQRAAGASGGVTVGVGVGTEQRNLSVVAPSQFTFSSRSPDFVDETAGQSWCAILGLNQFHGSGSGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 35 - protein, 1523 aa, Artificial Sequence
  Escherishia coli/Mycobacterium tuberculosis
MNRIYSLRYSAVARGFIAVSEFARKCVHKSVRRLCFPVLLLIPVLFSAGSLAGSSTGSAAIGLSMAGSSAMILAAYHPQQFIYAGSLSALLDPSQGMGPSLIGLAMGDAGGYKAADMWGPSSDPAWERNDPTQQIPKLVANNTRLWVYCGNGTPNELGGANIPAEFLENFVRSSNLKFQDAYNAAGGHNAVFNFPPNGTHSWEYWGAQLNAMKGDLQSSLGAGGSGSGNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYAGSGSSFSRPGLPVEYLQVPSPSMGRDIKVQFQSGGNNSPAVYLLDGLRAQDDYNGWDINTPAFEWYYQSGLSIVMPVGGQSSFYSDWYSPACGKAGCQTYKWETFLTSELPQWLSANRAVKPTGSAAIGLSGSGSGNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVAGSGSSMTEQQWNFAGIEAAASAIQGNVTSIHSLLDEGKQSLTKLAAAWGGSGSEAYQGVQQKWDATATELNNALQNLARTISEAGQAMASTEGNVTGMFAGSGSGKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGSGSSVIAGVDQALAATGQASQRAAGASGGVTVGVGVGTEQRNLSVVAPSQFTFSSRSPDFVDETAGQSWCAILGLNQFHGSGSGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVGSLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 36 - protein, 1306 aa, Escherichia coli
MNKIYALKYCHATGGLIAVSELASRVMKKAARGSLLALFNLSLYGAFLSASQAAQLNIDNVWARDYLDLAQNKGVFKAGATNVSIQLKNGQTFNFPNVPIPDFSPASNKGATTSIGGAYSVTATHNGTTHHAISTQNWGQSSYKYIDRMTNGDFAVTRLDKFVVETTGVKNSVDFSLNSHDALERYGVEINGEKKIIGFRVGAGTTYTAQNGNTYSTGQVYNPLLLSASMFQLNWDNKRPYNNTTPFYNETTGGDSGSGFYLYDNVKKEWVMLGTLFGIASSGADVGSILNQYDENTVNGLKNKFTQKVQLNNNTMSLNSDSFTLAGNNTAVAKNNNNYKDLSFSGGGSINFDNDVNIGSGGLIFDAGHHYTVTGNNKTFKGAGLDIGDNTTVDWNVKGVVGDNLHKIGAGTLNVNVSQGNNLKTGDGLVVLNSANAFDNIYMASGHGVVKINHSAALNQNNDYRGIFFTENGGTLDLNGYDQSFNKIAATDIGALITNSAVQKAVLSVNNQSHYMYHGSVSGNTEINHQFDTQKNNSRLILDGNVDITNDINIKNSQLHHAGTCLHLMLFLERVGVTCMLPGVICEKDYVSGIQQQENSANKNNNTDYKTNNQVSSFEQPDWENRLFKFKTLNLINSDFIVGRNAIVVGDISANNSTLSLSGKDTKVHIDMYDGKNITGDGFGFRQDIKDGVSVSPESSSYFGNVTLNNHSLLDIGNKFTGGIEAYDSSVSVTSQNAVFDRVGSFVNSSLTLEKGAKLTAQGGIFSTGAVDVKENASLILTGTPSAQKQEYYSPVISTTEGINLGDKASLSVKNMGYLSSDIHAGTTAATINLGDGDAETDSPLFSSLIRGYNAVLSGNITGEQSTVNMNNALWYSDGNSTIGTLKSTGGRVELGGGKDFATLRVKELNANNATFLMHTNTSQADQLNVTNKLLGSNNTVLVDFLNKPASEMNVTLITAPKGSDEKTFTAGTQQIGFSNVTPVISTEKTDDATKWMLTGYQTVSDAGASKTATDFMASGYKSFLTEVNNLNKRMGDLRDTQGDAGVWARIMNGTGSADGGYSDNYTHVQIGADRKHELDGVDLFTGALLTYTDSNASSHAFSGKTKSVGGGLYASALFDSGAYFDLIGKYLHHDNQYTASFASLGTKDYSSHSWYAGAEVGYRYHLSEESWVEPQMELVYGSVSGKSFIWEDRGMALSMKDKDYNPLIGRTGVDVGRTFSGDDWKITARAGLGYQFDLLANGETVLRDASGEKRFEGEKDSRMLMNVGMNAEIKDNMRFGLELEKSAFGKYNVDNAINANFRYSF

SEQ ID NO: 37 - protein, 1068 aa, Escherichia coli
MNKIYALKYCHATGGLIAVSELASRVMKKAARGSLLALFNLSLYGAFLSASQAGSSAGSGSGLKNKFTQKVQLNNNTMSLNSDSFTLAGNNTAVAKNNNNYKDLSFSGGGSINFDNDVNIGSGGLIFDAGHHYTVTGNNKTFKGAGLDIGDNTTVDWNVKGVVGDNLHKIGAGTLNVNVSQGNNLKTGDGLVVLNSANAFDNIYMASGHGVVKINHSAALNQNNDYRGIFFTENGGTLDLNGYDQSFNKIAATDIGALITNSAVQKAVLSVNNQSHYMYHGSVSGNTEINHQFDTQKNNSRLILDGNVDITNDINIKNSQLHHAGTCLHLMLFLERVGVTCMLPGVICEKDYVSGIQQQENSANKNNNTDYKTNNQVSSFEQPDWENRLFKFKTLNLINSDFIVGRNAIVVGDISANNSTLSLSGKDTKVHIDMYDGKNITGDGFGFRQDIKDGVSVSPESSSYFGNVTLNNHSLLDIGNKFTGGIEAYDSSVSVTSQNAVFDRVGSFVNSSLTLEKGAKLTAQGGIFSTGAVDVKENASLILTGTPSAQKQEYYSPVISTTEGINLGDKASLSVKNMGYLSSDIHAGTTAATINLGDGDAETDSPLFSSLIRGYNAVLSGNITGEQSTVNMNNALWYSDGNSTIGTLKSTGGRVELGGGKDFATLRVKELNANNATFLMHTNTSQADQLNVTNKLLGSNNTVLVDFLNKPASEMNVTLITAPKGSDEKTFTAGTQQIGFSNVTPVISTEKTDDATKWMLTGYQTVSDAGASKTATDFMASGYKSFLTEVNNLNKRMGDLRDTQGDAGVWARIMNGTGSADGGYSDNYTHVQIGADRKHELDGVDLFTGALLTYTDSNASSHAFSGKTKSVGGGLYASALFDSGAYFDLIGKYLHHDNQYTASFASLGTKDYSSHSWYAGAEVGYRYHLSEESWVEPQMELVYGSVSGKSFIWEDRGMALSMKDKDYNPLIGRTGVDVGRTFSGDDWKITARAGLGYQFDLLANGETVLRDASGEKRFEGEKDSRMLMNVGMNAEIKDNMRFGLELEKSAFGKYNVDNAINANFRYSF

SEQ ID NO: 38 - protein, 1162 aa, Artificial Sequence
  Escherishia coli/Mycobacterium tuberculosis
MNKIYALKYCHATGGLIAVSELASRVMKKAARGSLLALFNLSLYGAFLSASQAGSSMTEQQWNFAGIEAAASAIQGNVTSIHSLLDEGKQSLTKLAAAWGGSGSEAYQGVQQKWDATATELNNALQNLARTISEAGQAMASTEGNVTGMFAGSGSGLKNKFTQKVQLNNNTMSLNSDSFTLAGNNTAVAKNNNNYKDLSFSGGGSINFDNDVNIGSGGLIFDAGHHYTVTGNNKTFKGAGLDIGDNTTVDWNVKGVVGDNLHKIGAGTLNVNVSQGNNLKTGDGLVVLNSANAFDNIYMASGHGVVKINHSAALNQNNDYRGIFFTENGGTLDLNGYDQSFNKIAATDIGALITNSAVQKAVLSVNNQSHYMYHGSVSGNTEINHQFDTQKNNSRLILDGNVDITNDINIKNSQLHHAGTCLHLMLFLERVGVTCMLPGVICEKDYVSGIQQQENSANKNNNTDYKTNNQVSSFEQPDWENRLFKFKTLNLINSDFIVGRNAIVVGDISANNSTLSLSGKDTKVHIDMYDGKNITGDGFGFRQDIKDGVSVSPESSSYFGNVTLNNHSLLDIGNKFTGGIEAYDSSVSVTSQNAVFDRVGSFVNSSLTLEKGAKLTAQGGIFSTGAVDVKENASLILTGTPSAQKQEYYSPVISTTEGINLGDKASLSVKNMGYLSSDIHAGTTAATINLGDGDAETDSPLFSSLIRGYNAVLSGNITGEQSTVNMNNALWYSDGNSTIGTLKSTGGRVELGGGKDFATLRVKELNANNATFLMHTNTSQADQLNVTNKLLGSNNTVLVDFLNKPASEMNVTLITAPKGSDEKTFTAGTQQIGFSNVTPVISTEKTDDATKWMLTGYQTVSDAGASKTATDFMASGYKSFLTEVNNLNKRMGDLRDTQGDAGVWARIMNGTGSADGGYSDNYTHVQIGADRKHELDGVDLFTGALLTYTDSNASSHAFSGKTKSVGGGLYASALFDSGAYFDLIGKYLHHDNQYTASFASLGTKDYSSHSWYAGAEVGYRYHLSEESWVEPQMELVYGSVSGKSFIWEDRGMALSMKDKDYNPLIGRTGVDVGRTFSGDDWKITARAGLGYQFDLLANGETVLRDASGEKRFEGEKDSRMLMNVGMNAEIKDNMRFGLELEKSAFGKYNVDNAINANFRYSF

SEQ ID NO: 39 - protein, 95 aa, Mycobacterium tuberculosis
MTEQQWNFAGIEAAASAIQGNVTSIHSLLDEGKQSLTKLAAAWGGSGSEAYQGVQQKWDATATELNNALQNLARTISEAGQAMASTEGNVTGMFA

SEQ ID NO: 40 - protein, 285 aa, Mycobacterium tuberculosis
FSRPGLPVEYLQVPSPSMGRDIKVQFQSGGNNSPAVYLLDGLRAQDDYNGWDINTPAFEWYYQSGLSIVMPVGGQSSFYSDWYSPACGKAGCQTYKWETFLTSELPQWLSANRAVKPTGSAAIGLSMAGSSAMILAAYHPQQFIYAGSLSALLDPSQGMGPSLIGLAMGDAGGYKAANMWGPSSDPAWERNDPTQQIPKLVANNTRLWVYCGNGTPNELGGANIPAEFLKNFVRSSNLKFQDAYNAAGGHNAVFNFPPNGTHSWEYWGAQLNAMKGDLQSSLGAG

SEQ ID NO: 41 - protein, 75 aa, Mycobacterium tuberculosis
VIAGVDQALAATGQASQRAAGASGGVTVGVGVGTEQRNLSVVAPSQFTFSSRSPDFVDETAGQSWCAILGLNQFH

SEQ ID NO: 42 - protein, 96 aa, Mycobacterium tuberculosis
MSQIMYNYPAMLGHAGDMAGYAGTLQSLGAEIAVEQAALQSAWQGDTGITYQAWQAQWNQAMEDLVRAYHAMSSTHEANTMAMMARDTAEAAKWGG

SEQ ID NO: 43 - protein, 96 aa, Mycobacterium tuberculosis
MSQIMYNYPAMMAHAGDMAGYAGTLQSLGADIASEQAVLSSAWQGDTGITYQGWQTQWNQALEDLVRAYQSMSGTHESNTMAMLARDGAEAAKWGG

SEQ ID NO: 44 - protein, 11 aa, Artificial Sequence
  Artificial linker
GSGSSAGSGSG

SEQ ID NO: 45 - protein, 8 aa, Artificial Sequence
  Artificial linker
SSCGSGSG

SEQ ID NO: 46 - protein, 9 aa, Artificial Sequence
  Artificial linker
GSSAGSGSG

SEQ ID NO: 47 - protein, 7 aa, Artificial Sequence
  Artificial linker
SAGSGSG

SEQ ID NO: 48 - DNA, 4134 bp, Escherichia coli
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 49 - DNA, 4134 bp, Escherichia coli
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttggttccctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 50 - DNA, 1338 bp, Escherichia coli
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcggggagctcctgcggatccggcagcggtgcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 51 - DNA, 3396 bp, Escherichia coli
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcggggagctcctgcggatccggcagcggtaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 52 - DNA, 3396 bp, Escherichia coli
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcggggagctcctgcggatccggcagcggtaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttggttccctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 53 - DNA, 3945 bp, Escherichia coli
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccggttctgggagctccgcaggatccggcagcggtaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 54 - DNA, 3945 bp, Escherichia coli
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccggttctgggagctccgcaggatccggcagcggtaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttggttccctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 55 - DNA, 4053 bp, Escherichia coli
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggagcgggagctccgcaggatccggcagcggtaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 56 - DNA, 4077 bp, Escherichia coli
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacgggagcgggagctccgcaggatccggcagcggtagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 57 - DNA, 4101 bp, Escherichia coli
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggagggagcgggagctccgcaggatccggcagcgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 58 - DNA, 4152 bp, Escherichia coli
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaggttctgggagctccgcaggatccggcagcggtaaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 59 - DNA, 1620 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcggggagctccatgaccgaacagcagtggaacttcgcgggtatcgaagcggcggcgagcgcgatccagggtaacgtgaccagcatccacagcctgctggatgaaggtaaacagagcctgaccaaactggcggcggcctggggtggtagcggtagcgaagcgtatcagggtgtgcagcagaaatgggatgcgaccgcgaccgaactgaacaacgcgctgcagaacctggcgcgtaccatcagcgaagcgggtcaggcgatggcgagcaccgaaggtaacgtgaccggtatgttcgcgggatccggcagcggtgcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 60 - DNA, 3678 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcggggagctccatgaccgaacagcagtggaacttcgcgggtatcgaagcggcggcgagcgcgatccagggtaacgtgaccagcatccacagcctgctggatgaaggtaaacagagcctgaccaaactggcggcggcctggggtggtagcggtagcgaagcgtatcagggtgtgcagcagaaatgggatgcgaccgcgaccgaactgaacaacgcgctgcagaacctggcgcgtaccatcagcgaagcgggtcaggcgatggcgagcaccgaaggtaacgtgaccggtatgttcgcgggatccggcagcggtaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 61 - DNA, 3678 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcggggagctccatgaccgaacagcagtggaacttcgcgggtatcgaagcggcggcgagcgcgatccagggtaacgtgaccagcatccacagcctgctggatgaaggtaaacagagcctgaccaaactggcggcggcctggggtggtagcggtagcgaagcgtatcagggtgtgcagcagaaatgggatgcgaccgcgaccgaactgaacaacgcgctgcagaacctggcgcgtaccatcagcgaagcgggtcaggcgatggcgagcaccgaaggtaacgtgaccggtatgttcgcgggatccggcagcggtaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttggttccctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 62 - DNA, 4227 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccggttctgggagctccatgaccgaacagcagtggaacttcgcgggtatcgaagcggcggcgagcgcgatccagggtaacgtgaccagcatccacagcctgctggatgaaggtaaacagagcctgaccaaactggcggcggcctggggtggtagcggtagcgaagcgtatcagggtgtgcagcagaaatgggatgcgaccgcgaccgaactgaacaacgcgctgcagaacctggcgcgtaccatcagcgaagcgggtcaggcgatggcgagcaccgaaggtaacgtgaccggtatgttcgcgggatccggcagcggtaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 63 - DNA, 4227 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccggttctgggagctccatgaccgaacagcagtggaacttcgcgggtatcgaagcggcggcgagcgcgatccagggtaacgtgaccagcatccacagcctgctggatgaaggtaaacagagcctgaccaaactggcggcggcctggggtggtagcggtagcgaagcgtatcagggtgtgcagcagaaatgggatgcgaccgcgaccgaactgaacaacgcgctgcagaacctggcgcgtaccatcagcgaagcgggtcaggcgatggcgagcaccgaaggtaacgtgaccggtatgttcgcgggatccggcagcggtaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttggttccctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 64 - DNA, 4335 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggagcgggagctccatgaccgaacagcagtggaacttcgcgggtatcgaagcggcggcgagcgcgatccagggtaacgtgaccagcatccacagcctgctggatgaaggtaaacagagcctgaccaaactggcggcggcctggggtggtagcggtagcgaagcgtatcagggtgtgcagcagaaatgggatgcgaccgcgaccgaactgaacaacgcgctgcagaacctggcgcgtaccatcagcgaagcgggtcaggcgatggcgagcaccgaaggtaacgtgaccggtatgttcgcgggatccggcagcggtaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 65 - DNA, 4359 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacgggagcgggagctccatgaccgaacagcagtggaacttcgcgggtatcgaagcggcggcgagcgcgatccagggtaacgtgaccagcatccacagcctgctggatgaaggtaaacagagcctgaccaaactggcggcggcctggggtggtagcggtagcgaagcgtatcagggtgtgcagcagaaatgggatgcgaccgcgaccgaactgaacaacgcgctgcagaacctggcgcgtaccatcagcgaagcgggtcaggcgatggcgagcaccgaaggtaacgtgaccggtatgttcgcgggatccggcagcggtagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 66 - DNA, 4383 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggagggagcgggagctccatgaccgaacagcagtggaacttcgcgggtatcgaagcggcggcgagcgcgatccagggtaacgtgaccagcatccacagcctgctggatgaaggtaaacagagcctgaccaaactggcggcggcctggggtggtagcggtagcgaagcgtatcagggtgtgcagcagaaatgggatgcgaccgcgaccgaactgaacaacgcgctgcagaacctggcgcgtaccatcagcgaagcgggtcaggcgatggcgagcaccgaaggtaacgtgaccggtatgttcgcgggatccggcagcgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 67 - DNA, 4434 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaggttctgggagctccatgaccgaacagcagtggaacttcgcgggtatcgaagcggcggcgagcgcgatccagggtaacgtgaccagcatccacagcctgctggatgaaggtaaacagagcctgaccaaactggcggcggcctggggtggtagcggtagcgaagcgtatcagggtgtgcagcagaaatgggatgcgaccgcgaccgaactgaacaacgcgctgcagaacctggcgcgtaccatcagcgaagcgggtcaggcgatggcgagcaccgaaggtaacgtgaccggtatgttcgcgggatccggcagcggtaaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 68 - DNA, 4449 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcgggagcgggagctccatgaccgaacagcagtggaacttcgcgggtatcgaagcggcggcgagcgcgatccagggtaacgtgaccagcatccacagcctgctggatgaaggtaaacagagcctgaccaaactggcggcggcctggggtggtagcggtagcgaagcgtatcagggtgtgcagcagaaatgggatgcgaccgcgaccgaactgaacaacgcgctgcagaacctggcgcgtaccatcagcgaagcgggtcaggcgatggcgagcaccgaaggtaacgtgaccggtatgttcgcgggatccggcagcggtaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 69 - DNA, 4275 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggagcgggagctccgtgatagcgggcgtcgaccaggcgcttgcagcaacaggccaggctagccagcgggcggcaggcgcatctggtggggtcaccgtcggtgtcggcgtgggcacggaacagaggaacctttcggtggttgcaccgagtcagttcacatttagttcacgcagcccagattttgtggatgaaaccgcaggtcaatcgtggtgcgcgatactgggattgaaccagtttcacggatccggcagcggtaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 70 - DNA, 4299 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacgggagcgggagctccgtgatagcgggcgtcgaccaggcgcttgcagcaacaggccaggctagccagcgggcggcaggcgcatctggtggggtcaccgtcggtgtcggcgtgggcacggaacagaggaacctttcggtggttgcaccgagtcagttcacatttagttcacgcagcccagattttgtggatgaaaccgcaggtcaatcgtggtgcgcgatactgggattgaaccagtttcacggatccggcagcggtagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 71 - DNA, 4323 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggagggagcgggagctccgtgatagcgggcgtcgaccaggcgcttgcagcaacaggccaggctagccagcgggcggcaggcgcatctggtggggtcaccgtcggtgtcggcgtgggcacggaacagaggaacctttcggtggttgcaccgagtcagttcacatttagttcacgcagcccagattttgtggatgaaaccgcaggtcaatcgtggtgcgcgatactgggattgaaccagtttcacggatccggcagcgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 72 - DNA, 3681 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcggggagctccatgtcgcaaatcatgtacaactaccccgcgatgttgggtcacgccggggatatggccggatatgccggcacgctgcagagcttgggtgccgagatcgccgtggagcaggccgcgttgcagagtgcgtggcagggcgataccgggatcacgtatcaggcgtggcaggcacagtggaaccaggccatggaagatttggtgcgggcctatcatgcgatgtccagcacccatgaagccaacaccatggcgatgatggcccgcgacacggccgaagccgccaaatggggcggcggatccggcagcggtaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 73 - DNA, 4230 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcgggaacggtcaataatgaactcgggtatcagttatttcgtgattttgctgaaaataaggggatgttccgcccgggggcaacgaatatcgctatttataataagcagggagaatttgtcggtacgctggataaggcagctatgcctgatttcagtgctgtggattcggaaatcggtgtggcgacactgataaacccgcagtatatcgccagcgtgaaacataacgggggatatacaaacgttagctttggtgatggtgaaaaccgttacaatatcgtggaccggaataatgcgccgtcactggattttcatgccccccggctggataaactggtgacagaggttgcccctactgcggtgacggcgcagggggcagtggctggcgcatatctggataaggagcgctatcctgttttttatcgtctggggtctggtactcagtatattaaggacagtaacggacagctgacaaaaatgggaggtgcatattcctggctgaccggcgggactgtcggtagcctgtcatcctatcagaatggagaaatgattagcaccagttcaggtctggtttttgattacaaacttaatggtgcaatgcccatttatggcgaggccggtgacagcggttcgcctttatttgcttttgatactgttcagaataaatgggtgctggtcggtgttcttactgcggggaatggcgcggggggcaggggaaataactgggctgttattccactggattttatcgggcagaaatttaatgaagacaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccggttctgggagctccatgtcgcagattatgtacaactatccggcgatgatggctcatgccggggacatggccggttatgcgggcacgctgcagagcttgggggccgatatcgccagtgagcaggccgtgctgtccagtgcttggcagggtgataccgggatcacgtatcagggctggcagacccagtggaaccaggccctagaggatctggtgcgggcctatcagtcgatgtctggcacccatgagtccaacaccatggcgatgttggctcgagatggggccgaagccgccaagtggggcggcggatccggcagcggtaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 74 - DNA, 3552 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcggggagctccaattctgattctgagagtccattgtctcacgatggttacagcttgcatgatggtgtttcaatgtacattgaagcattggataagtatgcttctaactctgttgttggttacattggtgaaagatctcaatatagagatttgaagtggtgggaattgagaggatccggcagcggtaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccctgcgggctgacaaagtagcactgaatggctggtcggaatcaggtaaaggaactgccggaaatttatataaatacaataacccgtacacaaatacgacggattacttcatcctgaagcagagcacctatggttatttccccacggaccagagcagcaacgccacctgggagtttgtggggcacagtcagggggatgcacagaaactggtagctgaccgtttcaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 75 - DNA, 4083 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcggggagctccttctcccggccggggctgccggtcgagtacctgcaggtgccgtcgccgtcgatgggccgcgacatcaaggttcagttccagagcggtgggaacaactcacctgcggtttatctgctcgacggcctgcgcgcccaagacgactacaacggctgggatatcaacaccccggcgttcgagtggtactaccagtcgggactgtcgatagtcatgccggtcggcgggcagtccagcttctacagcgactggtacagcccggcctgcggtaaggctggctgccagacttacaagtgggaaaccttcctgaccagcgagctgccgcaatggttgtccgccaacagggccgtgaagcccaccggcagcgctgcaatcggcttgtcgggatccggcagcggtaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccggttctgggagctccaccggcagcgctgcaatcggcttgtcgatggccggctcgtcggcaatgatcttggccgcctaccacccccagcagttcatctacgccggctcgctgtcggccctgctggacccctctcaggggatggggcctagcctgatcggcctcgcgatgggtgacgccggcggttacaaggccgcagacatgtggggtccctcgagtgacccggcatgggagcgcaacgaccctacgcagcagatccccaagctggtcgcaaacaacacccggctatgggtttattgcgggaacggcaccccgaacgagttgggcggtgccaacatacccgccgagttcttggagaacttcgttcgtagcagcaacctgaagttccaggatgcgtacaacgccgcgggcgggcacaacgccgtgttcaacttcccgcccaacggcacgcacagctgggagtactggggcgctcagctcaacgccatgaagggtgacctgcagagttcgttaggcgccggcggatccggcagcggtaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 76 - DNA, 4083 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcggggagctccttctcccggccggggctgccggtcgagtacctgcaggtgccgtcgccgtcgatgggccgcgacatcaaggttcagttccagagcggtgggaacaactcacctgcggtttatctgctcgacggcctgcgcgcccaagacgactacaacggctgggatatcaacaccccggcgttcgagtggtactaccagtcgggactgtcgatagtcatgccggtcggcgggcagtccagcttctacagcgactggtacagcccggcctgcggtaaggctggctgccagacttacaagtgggaaaccttcctgaccagcgagctgccgcaatggttgtccgccaacagggccgtgaagcccaccggcagcgctgcaatcggcttgtcgggatccggcagcggtaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccggttctgggagctccaccggcagcgctgcaatcggcttgtcgatggccggctcgtcggcaatgatcttggccgcctaccacccccagcagttcatctacgccggctcgctgtcggccctgctggacccctctcaggggatggggcctagcctgatcggcctcgcgatgggtgacgccggcggttacaaggccgcagacatgtggggtccctcgagtgacccggcatgggagcgcaacgaccctacgcagcagatccccaagctggtcgcaaacaacacccggctatgggtttattgcgggaacggcaccccgaacgagttgggcggtgccaacatacccgccgagttcttggagaacttcgttcgtagcagcaacctgaagttccaggatgcgtacaacgccgcgggcgggcacaacgccgtgttcaacttcccgcccaacggcacgcacagctgggagtactggggcgctcagctcaacgccatgaagggtgacctgcagagttcgttaggcgccggcggatccggcagcggtaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttggttccctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 77 - DNA, 4083 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcggggagctccaccggcagcgctgcaatcggcttgtcgatggccggctcgtcggcaatgatcttggccgcctaccacccccagcagttcatctacgccggctcgctgtcggccctgctggacccctctcaggggatggggcctagcctgatcggcctcgcgatgggtgacgccggcggttacaaggccgcagacatgtggggtccctcgagtgacccggcatgggagcgcaacgaccctacgcagcagatccccaagctggtcgcaaacaacacccggctatgggtttattgcgggaacggcaccccgaacgagttgggcggtgccaacatacccgccgagttcttggagaacttcgttcgtagcagcaacctgaagttccaggatgcgtacaacgccgcgggcgggcacaacgccgtgttcaacttcccgcccaacggcacgcacagctgggagtactggggcgctcagctcaacgccatgaagggtgacctgcagagttcgttaggcgccggcggatccggcagcggtaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccggttctgggagctccttctcccggccggggctgccggtcgagtacctgcaggtgccgtcgccgtcgatgggccgcgacatcaaggttcagttccagagcggtgggaacaactcacctgcggtttatctgctcgacggcctgcgcgcccaagacgactacaacggctgggatatcaacaccccggcgttcgagtggtactaccagtcgggactgtcgatagtcatgccggtcggcgggcagtccagcttctacagcgactggtacagcccggcctgcggtaaggctggctgccagacttacaagtgggaaaccttcctgaccagcgagctgccgcaatggttgtccgccaacagggccgtgaagcccaccggcagcgctgcaatcggcttgtcgggatccggcagcggtaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 78 - DNA, 4083 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcggggagctccaccggcagcgctgcaatcggcttgtcgatggccggctcgtcggcaatgatcttggccgcctaccacccccagcagttcatctacgccggctcgctgtcggccctgctggacccctctcaggggatggggcctagcctgatcggcctcgcgatgggtgacgccggcggttacaaggccgcagacatgtggggtccctcgagtgacccggcatgggagcgcaacgaccctacgcagcagatccccaagctggtcgcaaacaacacccggctatgggtttattgcgggaacggcaccccgaacgagttgggcggtgccaacatacccgccgagttcttggagaacttcgttcgtagcagcaacctgaagttccaggatgcgtacaacgccgcgggcgggcacaacgccgtgttcaacttcccgcccaacggcacgcacagctgggagtactggggcgctcagctcaacgccatgaagggtgacctgcagagttcgttaggcgccggcggatccggcagcggtaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccggttctgggagctccttctcccggccggggctgccggtcgagtacctgcaggtgccgtcgccgtcgatgggccgcgacatcaaggttcagttccagagcggtgggaacaactcacctgcggtttatctgctcgacggcctgcgcgcccaagacgactacaacggctgggatatcaacaccccggcgttcgagtggtactaccagtcgggactgtcgatagtcatgccggtcggcgggcagtccagcttctacagcgactggtacagcccggcctgcggtaaggctggctgccagacttacaagtgggaaaccttcctgaccagcgagctgccgcaatggttgtccgccaacagggccgtgaagcccaccggcagcgctgcaatcggcttgtcgggatccggcagcggtaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaactaaagatgcagataaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttggttccctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 79 - DNA, 4383 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcggggagctccaccggcagcgctgcaatcggcttgtcgatggccggctcgtcggcaatgatcttggccgcctaccacccccagcagttcatctacgccggctcgctgtcggccctgctggacccctctcaggggatggggcctagcctgatcggcctcgcgatgggtgacgccggcggttacaaggccgcagacatgtggggtccctcgagtgacccggcatgggagcgcaacgaccctacgcagcagatccccaagctggtcgcaaacaacacccggctatgggtttattgcgggaacggcaccccgaacgagttgggcggtgccaacatacccgccgagttcttggagaacttcgttcgtagcagcaacctgaagttccaggatgcgtacaacgccgcgggcgggcacaacgccgtgttcaacttcccgcccaacggcacgcacagctgggagtactggggcgctcagctcaacgccatgaagggtgacctgcagagttcgttaggcgccggcggatccggcagcggtaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccggttctgggagctccttctcccggccggggctgccggtcgagtacctgcaggtgccgtcgccgtcgatgggccgcgacatcaaggttcagttccagagcggtgggaacaactcacctgcggtttatctgctcgacggcctgcgcgcccaagacgactacaacggctgggatatcaacaccccggcgttcgagtggtactaccagtcgggactgtcgatagtcatgccggtcggcgggcagtccagcttctacagcgactggtacagcccggcctgcggtaaggctggctgccagacttacaagtgggaaaccttcctgaccagcgagctgccgcaatggttgtccgccaacagggccgtgaagcccaccggcagcgctgcaatcggcttgtcgggatccggcagcggtaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaggttctgggagctccatgaccgaacagcagtggaacttcgcgggtatcgaagcggcggcgagcgcgatccagggtaacgtgaccagcatccacagcctgctggatgaaggtaaacagagcctgaccaaactggcggcggcctggggtggtagcggtagcgaagcgtatcagggtgtgcagcagaaatgggatgcgaccgcgaccgaactgaacaacgcgctgcagaacctggcgcgtaccatcagcgaagcgggtcaggcgatggcgagcaccgaaggtaacgtgaccggtatgttcgcgggatccggcagcggtaaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 80 - DNA, 4383 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcggggagctccaccggcagcgctgcaatcggcttgtcgatggccggctcgtcggcaatgatcttggccgcctaccacccccagcagttcatctacgccggctcgctgtcggccctgctggacccctctcaggggatggggcctagcctgatcggcctcgcgatgggtgacgccggcggttacaaggccgcagacatgtggggtccctcgagtgacccggcatgggagcgcaacgaccctacgcagcagatccccaagctggtcgcaaacaacacccggctatgggtttattgcgggaacggcaccccgaacgagttgggcggtgccaacatacccgccgagttcttggagaacttcgttcgtagcagcaacctgaagttccaggatgcgtacaacgccgcgggcgggcacaacgccgtgttcaacttcccgcccaacggcacgcacagctgggagtactggggcgctcagctcaacgccatgaagggtgacctgcagagttcgttaggcgccggcggatccggcagcggtaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccggttctgggagctccttctcccggccggggctgccggtcgagtacctgcaggtgccgtcgccgtcgatgggccgcgacatcaaggttcagttccagagcggtgggaacaactcacctgcggtttatctgctcgacggcctgcgcgcccaagacgactacaacggctgggatatcaacaccccggcgttcgagtggtactaccagtcgggactgtcgatagtcatgccggtcggcgggcagtccagcttctacagcgactggtacagcccggcctgcggtaaggctggctgccagacttacaagtgggaaaccttcctgaccagcgagctgccgcaatggttgtccgccaacagggccgtgaagcccaccggcagcgctgcaatcggcttgtcgggatccggcagcggtaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaggttctgggagctccatgaccgaacagcagtggaacttcgcgggtatcgaagcggcggcgagcgcgatccagggtaacgtgaccagcatccacagcctgctggatgaaggtaaacagagcctgaccaaactggcggcggcctggggtggtagcggtagcgaagcgtatcagggtgtgcagcagaaatgggatgcgaccgcgaccgaactgaacaacgcgctgcagaacctggcgcgtaccatcagcgaagcgggtcaggcgatggcgagcaccgaaggtaacgtgaccggtatgttcgcgggatccggcagcggtaaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttggttccctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 81 - DNA, 4572 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcggggagctccaccggcagcgctgcaatcggcttgtcgatggccggctcgtcggcaatgatcttggccgcctaccacccccagcagttcatctacgccggctcgctgtcggccctgctggacccctctcaggggatggggcctagcctgatcggcctcgcgatgggtgacgccggcggttacaaggccgcagacatgtggggtccctcgagtgacccggcatgggagcgcaacgaccctacgcagcagatccccaagctggtcgcaaacaacacccggctatgggtttattgcgggaacggcaccccgaacgagttgggcggtgccaacatacccgccgagttcttggagaacttcgttcgtagcagcaacctgaagttccaggatgcgtacaacgccgcgggcgggcacaacgccgtgttcaacttcccgcccaacggcacgcacagctgggagtactggggcgctcagctcaacgccatgaagggtgacctgcagagttcgttaggcgccggcggatccggcagcggtaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccggttctgggagctccttctcccggccggggctgccggtcgagtacctgcaggtgccgtcgccgtcgatgggccgcgacatcaaggttcagttccagagcggtgggaacaactcacctgcggtttatctgctcgacggcctgcgcgcccaagacgactacaacggctgggatatcaacaccccggcgttcgagtggtactaccagtcgggactgtcgatagtcatgccggtcggcgggcagtccagcttctacagcgactggtacagcccggcctgcggtaaggctggctgccagacttacaagtgggaaaccttcctgaccagcgagctgccgcaatggttgtccgccaacagggccgtgaagcccaccggcagcgctgcaatcggcttgtcgggatccggcagcggtaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaggttctgggagctccatgaccgaacagcagtggaacttcgcgggtatcgaagcggcggcgagcgcgatccagggtaacgtgaccagcatccacagcctgctggatgaaggtaaacagagcctgaccaaactggcggcggcctggggtggtagcggtagcgaagcgtatcagggtgtgcagcagaaatgggatgcgaccgcgaccgaactgaacaacgcgctgcagaacctggcgcgtaccatcagcgaagcgggtcaggcgatggcgagcaccgaaggtaacgtgaccggtatgttcgcgggatccggcagcggtaaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggagggagcgggagctccgtgatagcgggcgtcgaccaggcgcttgcagcaacaggccaggctagccagcgggcggcaggcgcatctggtggggtcaccgtcggtgtcggcgtgggcacggaacagaggaacctttcggtggttgcaccgagtcagttcacatttagttcacgcagcccagattttgtggatgaaaccgcaggtcaatcgtggtgcgcgatactgggattgaaccagtttcacggatccggcagcgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 82 - DNA, 4572 bp, Artificial Sequence
  Escherishia coli/Mycobacterium tuberculosis
atgaacagaatttattctcttcgctacagcgctgtggcccggggctttattgccgtatctgagtttgctaggaaatgtgttcataagtctgtcagacgtctgtgtttcccggttttattactgatcccggtactattctctgcaggaagtcttgcggggagctccaccggcagcgctgcaatcggcttgtcgatggccggctcgtcggcaatgatcttggccgcctaccacccccagcagttcatctacgccggctcgctgtcggccctgctggacccctctcaggggatggggcctagcctgatcggcctcgcgatgggtgacgccggcggttacaaggccgcagacatgtggggtccctcgagtgacccggcatgggagcgcaacgaccctacgcagcagatccccaagctggtcgcaaacaacacccggctatgggtttattgcgggaacggcaccccgaacgagttgggcggtgccaacatacccgccgagttcttggagaacttcgttcgtagcagcaacctgaagttccaggatgcgtacaacgccgcgggcgggcacaacgccgtgttcaacttcccgcccaacggcacgcacagctgggagtactggggcgctcagctcaacgccatgaagggtgacctgcagagttcgttaggcgccggcggatccggcagcggtaatgatgccccggtcacgttcagaacatcggaaggtggtgcactggagtggagctttaacagcagtaccggagctggtgcgctgacacagggaaccaccacatatgccatgcacgggcagcagggaaatgacctgaatgctggtaagaacctgatatttcaggggcagaatggtcagattaaccttaaggattcggtttctcagggggcgggttccctgacgttccgtgataattacacagtaacaacctctaacggaagtacctggaccggtgccggtattgttgtggacaacggggtgtccgtaaactggcaggttaatggtgttaagggcgataacctgcataaaattggtgaaggtacgctgacggtacagggtacaggtattaatgaaggtggcctgaaggtcggggacggaaaggttgtactgaaccagcaggcggacaataaaggacaggtgcaggcgttcagcagtgttaatattgccagtggccggccgaccgtggtactgactgatgagcggcaggtaaatccggataccgtctcatggggatatcgtgggggcacactggatgttaatggtaacagtctgacgtttcatcagttgaaggcggcagattatggtgccgtgctggcgaataacgttgataaacgggccactatcacgctggactatgccggttctgggagctccttctcccggccggggctgccggtcgagtacctgcaggtgccgtcgccgtcgatgggccgcgacatcaaggttcagttccagagcggtgggaacaactcacctgcggtttatctgctcgacggcctgcgcgcccaagacgactacaacggctgggatatcaacaccccggcgttcgagtggtactaccagtcgggactgtcgatagtcatgccggtcggcgggcagtccagcttctacagcgactggtacagcccggcctgcggtaaggctggctgccagacttacaagtgggaaaccttcctgaccagcgagctgccgcaatggttgtccgccaacagggccgtgaagcccaccggcagcgctgcaatcggcttgtcgggatccggcagcggtaatactgcagggtatctgtttcacggacaactgaaaggcaatctgaatgtggacaatcgcctgcctgaaggcgttaccggtgctctggtgatggacggagctgcggatatctccggtacattcacccaggaaaacgggcgtctgacgctgcaggggcatccggttatccatgcatacaatactcagtctgtggctgacaaactggctgccagtggagaccattcggttctgactcagcctacgtcattcagtcaggaggactgggagaaccgcagttttacctttgacaggctgtcactgaagaacactgattttggtcttggtcgcaatgccacactgaacacaaccatccaggcagataactccagcgtcacgctgggcgacagccgggtatttatcgacaaaaacgatggccagggaacagcctttacccttgaagaaggcacatctgttgcaggttctgggagctccatgaccgaacagcagtggaacttcgcgggtatcgaagcggcggcgagcgcgatccagggtaacgtgaccagcatccacagcctgctggatgaaggtaaacagagcctgaccaaactggcggcggcctggggtggtagcggtagcgaagcgtatcagggtgtgcagcagaaatgggatgcgaccgcgaccgaactgaacaacgcgctgcagaacctggcgcgtaccatcagcgaagcgggtcaggcgatggcgagcaccgaaggtaacgtgaccggtatgttcgcgggatccggcagcggtaaaagtgtcttcaacggcaccgtcaacctggataatcagtcagtgctgaatatcaatgatatattcaatggcggaatacaggcgaacaacagtaccgtgaatatctcctcagacagtgccgttctggggaactcaacactgaccagtaccgccctgaatctgaacaagggagcaaatgctctggccagtcagagttttgtttctgacggtccagtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggagggagcgggagctccgtgatagcgggcgtcgaccaggcgcttgcagcaacaggccaggctagccagcgggcggcaggcgcatctggtggggtcaccgtcggtgtcggcgtgggcacggaacagaggaacctttcggtggttgcaccgagtcagttcacatttagttcacgcagcccagattttgtggatgaaaccgcaggtcaatcgtggtgcgcgatactgggattgaaccagtttcacggatccggcagcgggtaccgcaatatctggagcgggagcctgaatgcaccggatgccaccgtcagcatgacagacacccagtggtcgatgaacggaaactccacggcaggaaatatgaaacttaaccggacaatagtcggttttaacgggggaacatcaccgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccttctaacaaggacacgcttgatattccactggtcagcgcacctgaagcgacagctgataatctgttcagggcatcaacacgggttgtgggattcagtgatgtcacccccatccttagtgtcagaaaagaggacgggaaaaaagagtgggtcctcgatggttaccaggttgcacgtaacgacggccagggtaaggctgccgccacattcatgcacatcagctataacaacttcatcactgaagttggttccctgaacaaacgcatgggcgatttgagggatattaatggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcagacctgtacagcggtaaaacaaaatcatggggtggtggtttctatgccagtggtctgttccggtccggcgcttactttgatgtgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacagcccgtgccggcctgcattatgagttcgatctgacggacagtgctgacgttcatctgaaggatgcagcgggagaacatcagattaatggcagaaaagacagtcgtatgctttacggtgtggggttaaatgcccggtttggcgacaatacgcgtctggggctggaagttgaacgctctgcatttggtaaatacaacacagatgatgcgataaacgctaatattcgttattcattctga

SEQ ID NO: 83 - DNA, 3921 bp, Escherichia coli
atgaataaaatatacgcattaaaatattgtcacgcgacaggggggctgattgctgtatccgaactggcctccagagttatgaagaaagccgctcgcggcagccttttagcattatttaatctatcattgtatggtgcttttttaagcgcatctcaggctgctcaactaaatattgataatgtatgggctagagattatttagacctcgcacaaaataagggggtgtttaaagctggtgcgaccaatgtttcaattcaactcaagaatggccagacgtttaattttccaaatgttccaattcctgatttctcgccggcctcaaataaaggcgctactacatctataggtggagcttatagtgtcacagcaacccataacggaacaactcatcatgcaataagcacccaaaactggggacaaagctcatataaatatatagaccggatgacgaatggagattttgctgtaacacgacttgataagtttgttgttgaaacaacaggggtaaaaaattcagtagatttttctctcaatagtcatgatgctcttgaacgttatggtgtggagatcaatggtgagaaaaaaatcattggtttcagggttggggctgggacgacttataccgctcaaaatggtaatacatatagtacaggacaggtatacaatcctcttttgttaagcgcttcaatgtttcagttaaactgggataacaaaagaccatataataacacgacacctttttataatgaaactaccggtggagacagtggttccggtttctatctgtatgataacgtaaaaaaagaatgggttatgcttggtactttatttggaatagcatccagtggtgcagatgttgggtctattctgaatcagtatgatgaaaatacagttaatggtttaaaaaacaaatttactcaaaaagtccagttaaacaataatacaatgtcgcttaatagtgacagttttacgttagctggtaataatacagcagtggcaaaaaataataataactataaagatctaagttttagtggtggtggaagtattaatttcgacaatgacgtaaacattggctctggtggtctcatttttgatgcagggcatcattatactgtcactggtaataataaaacattcaagggtgccgggctggatattggtgacaatactacagtcgactggaatgtgaaaggggttgtcggtgataacctgcataaaattggtgcaggtacattgaatgttaatgtttctcaaggtaataatcttaaaacgggggatggtcttgtcgtattaaatagcgctaatgcatttgataatatttatatggccagtggtcatggtgttgtaaaaattaatcatagtgcagcgcttaaccagaacaatgactatagaggtattttctttactgaaaatggtggtactctggatttaaatggttatgaccagagttttaataaaattgcagcgacagatataggagcactcataacaaatagtgcagtgcagaaagcagttctttctgttaataatcagtcacactatatgtatcatggttctgtttcaggtaatacagagataaaccaccagtttgatacccaaaaaaataatagtcgcctgattctggacggtaatgtcgatattacaaatgacattaacattaagaatagccagctccaccatgcagggacatgcctacatctcatgctgtttttagagagggtgggggttacctgcatgctgccaggagttatttgtgaaaaggattatgtttcaggcatacagcaacaggaaaactcagccaataaaaataataatacagattataagaccaataatcaggtatcatcatttgagcaacctgactgggaaaatcgtctgtttaagtttaagacattgaatctgataaattcagattttatcgttggccgtaatgctattgttgttggtgatatttctgccaataattccactctgtctttaagtggaaaagatacaaaagtacatattgatatgtatgacggcaaaaacatcacgggagatggcttcggttttcggcaggatattaaagatggtgtatctgtttctcctgagagcagcagttattttggaaatgttacgctgaataatcactcattactggatattggtaataaatttaccggtggtatcgaggcttatgacagctccgtgagtgtgacctcacagaatgctgtttttgatcgtgttggcagctttgtcaacagcagcctgaccctcgaaaaaggagcaaaactaacggctcagggcggtattttcagcaccggggctgtggacgtaaaagaaaatgcctccctgatcctgacggggacaccttctgcacagaaacaggagtattactcccctgtgatttctacaacggaagggattaacctcggagataaggccagcctttctgttaaaaacatgggctatctgagttcggatattcatgcaggaaccacggcggcaaccattaatctgggagacggtgatgctgagacggattctccgttattcagctccctgataaggggatataacgcggttctgagtggcaacattacgggtgagcagagtacggtaaatatgaacaatgctctgtggtactctgacggaaactcaacgatcggaacgctgaagagtacggggggacgagttgaactggggggcgggaaagactttgccaccctgcgggtaaaagagcttaacgcaaataacgccacattcctgatgcataccaacaccagtcaggctgaccagctgaatgtcacgaataaactgttgggcagtaataataccgtcctggtcgactttttaaacaagccagccagtgaaatgaacgtgacgttaattaccgcaccgaaagggagtgacgagaaaacgttcactgcaggaacgcagcagattggtttcagtaatgtcacgccggtaatcagcacagaaaaaacggatgatgccacaaaatggatgctgacagggtatcagaccgtctctgatgccggtgcctcgaaaaccgcaacggactttatggcgtcaggttataaatccttcctgacagaggtcaataatctgaacaagcgtatgggtgacctgcgggatactcagggggatgccggcgtctgggcgcgcatcatgaacggtaccggttcggcagatggtggttacagcgataactacactcacgttcagattggtgccgacagaaagcatgagctggacggtgtggatttgttcacgggtgcattactgacctatacagacagcaatgcaagcagccacgccttcagtggtaaaaccaaatccgtggggggagggttgtacgcttcagcactctttgattccggggcttattttgacctgattggtaaatatctccatcacgacaatcagtacacggcgagttttgcgtctcttggtacaaaagactacagctctcattcctggtatgccggtgcagaggtcgggtatcgttaccacctgtcggaagagtcctgggtggagccacagatggagctggtttacggttctgtgtcaggaaaatcttttatctgggaagaccggggaatggccctgagcatgaaagacaaggattataacccactgattggccgtaccggtgttgacgtgggaagaaccttctccggagacgactggaaaattaccgcgcgagccgggctgggttaccagttcgacctgctggcgaacggagaaacggttctgcgggatgcatccggagagaaacgttttgaaggtgaaaaggacagcagaatgctgatgaatgtggggatgaatgcggaaattaaggataatatgcgttttggcttggagctggaaaaatcggcgttcgggaaatataacgtggacaatgcgataaacgctaacttccgttattctttctga

SEQ ID NO: 84 - DNA, 3207 bp, Escherichia coli
atgaataaaatatacgcattaaaatattgtcacgcgacaggggggctgattgctgtatccgaactggcctccagagttatgaagaaagccgctcgcggcagccttttagcattatttaatctatcattgtatggtgcttttttaagcgcatctcaggctgggagctccgcaggatccggcagcggtttaaaaaacaaatttactcaaaaagtccagttaaacaataatacaatgtcgcttaatagtgacagttttacgttagctggtaataatacagcagtggcaaaaaataataataactataaagatctaagttttagtggtggtggaagtattaatttcgacaatgacgtaaacattggctctggtggtctcatttttgatgcagggcatcattatactgtcactggtaataataaaacattcaagggtgccgggctggatattggtgacaatactacagtcgactggaatgtgaaaggggttgtcggtgataacctgcataaaattggtgcaggtacattgaatgttaatgtttctcaaggtaataatcttaaaacgggggatggtcttgtcgtattaaatagcgctaatgcatttgataatatttatatggccagtggtcatggtgttgtaaaaattaatcatagtgcagcgcttaaccagaacaatgactatagaggtattttctttactgaaaatggtggtactctggatttaaatggttatgaccagagttttaataaaattgcagcgacagatataggagcactcataacaaatagtgcagtgcagaaagcagttctttctgttaataatcagtcacactatatgtatcatggttctgtttcaggtaatacagagataaaccaccagtttgatacccaaaaaaataatagtcgcctgattctggacggtaatgtcgatattacaaatgacattaacattaagaatagccagctccaccatgcagggacatgcctacatctcatgctgtttttagagagggtgggggttacctgcatgctgccaggagttatttgtgaaaaggattatgtttcaggcatacagcaacaggaaaactcagccaataaaaataataatacagattataagaccaataatcaggtatcatcatttgagcaacctgactgggaaaatcgtctgtttaagtttaagacattgaatctgataaattcagattttatcgttggccgtaatgctattgttgttggtgatatttctgccaataattccactctgtctttaagtggaaaagatacaaaagtacatattgatatgtatgacggcaaaaacatcacgggagatggcttcggttttcggcaggatattaaagatggtgtatctgtttctcctgagagcagcagttattttggaaatgttacgctgaataatcactcattactggatattggtaataaatttaccggtggtatcgaggcttatgacagctccgtgagtgtgacctcacagaatgctgtttttgatcgtgttggcagctttgtcaacagcagcctgaccctcgaaaaaggagcaaaactaacggctcagggcggtattttcagcaccggggctgtggacgtaaaagaaaatgcctccctgatcctgacggggacaccttctgcacagaaacaggagtattactcccctgtgatttctacaacggaagggattaacctcggagataaggccagcctttctgttaaaaacatgggctatctgagttcggatattcatgcaggaaccacggcggcaaccattaatctgggagacggtgatgctgagacggattctccgttattcagctccctgataaggggatataacgcggttctgagtggcaacattacgggtgagcagagtacggtaaatatgaacaatgctctgtggtactctgacggaaactcaacgatcggaacgctgaagagtacggggggacgagttgaactggggggcgggaaagactttgccaccctgcgggtaaaagagcttaacgcaaataacgccacattcctgatgcataccaacaccagtcaggctgaccagctgaatgtcacgaataaactgttgggcagtaataataccgtcctggtcgactttttaaacaagccagccagtgaaatgaacgtgacgttaattaccgcaccgaaagggagtgacgagaaaacgttcactgcaggaacgcagcagattggtttcagtaatgtcacgccggtaatcagcacagaaaaaacggatgatgccacaaaatggatgctgacagggtatcagaccgtctctgatgccggtgcctcgaaaaccgcaacggactttatggcgtcaggttataaatccttcctgacagaggtcaataatctgaacaagcgtatgggtgacctgcgggatactcagggggatgccggcgtctgggcgcgcatcatgaacggtaccggttcggcagatggtggttacagcgataactacactcacgttcagattggtgccgacagaaagcatgagctggacggtgtggatttgttcacgggtgcattactgacctatacagacagcaatgcaagcagccacgccttcagtggtaaaaccaaatccgtggggggagggttgtacgcttcagcactctttgattccggggcttattttgacctgattggtaaatatctccatcacgacaatcagtacacggcgagttttgcgtctcttggtacaaaagactacagctctcattcctggtatgccggtgcagaggtcgggtatcgttaccacctgtcggaagagtcctgggtggagccacagatggagctggtttacggttctgtgtcaggaaaatcttttatctgggaagaccggggaatggccctgagcatgaaagacaaggattataacccactgattggccgtaccggtgttgacgtgggaagaaccttctccggagacgactggaaaattaccgcgcgagccgggctgggttaccagttcgacctgctggcgaacggagaaacggttctgcgggatgcatccggagagaaacgttttgaaggtgaaaaggacagcagaatgctgatgaatgtggggatgaatgcggaaattaaggataatatgcgttttggcttggagctggaaaaatcggcgttcgggaaatataacgtggacaatgcgataaacgctaacttccgttattctttctga

SEQ ID NO: 85 - DNA, 3489 bp, Artificial Sequence
  Escherishia coli/Mycobacterium tuberculosis
atgaataaaatatacgcattaaaatattgtcacgcgacaggggggctgattgctgtatccgaactggcctccagagttatgaagaaagccgctcgcggcagccttttagcattatttaatctatcattgtatggtgcttttttaagcgcatctcaggctgggagctccatgaccgaacagcagtggaacttcgcgggtatcgaagcggcggcgagcgcgatccagggtaacgtgaccagcatccacagcctgctggatgaaggtaaacagagcctgaccaaactggcggcggcctggggtggtagcggtagcgaagcgtatcagggtgtgcagcagaaatgggatgcgaccgcgaccgaactgaacaacgcgctgcagaacctggcgcgtaccatcagcgaagcgggtcaggcgatggcgagcaccgaaggtaacgtgaccggtatgttcgcgggatccggcagcggtttaaaaaacaaatttactcaaaaagtccagttaaacaataatacaatgtcgcttaatagtgacagttttacgttagctggtaataatacagcagtggcaaaaaataataataactataaagatctaagttttagtggtggtggaagtattaatttcgacaatgacgtaaacattggctctggtggtctcatttttgatgcagggcatcattatactgtcactggtaataataaaacattcaagggtgccgggctggatattggtgacaatactacagtcgactggaatgtgaaaggggttgtcggtgataacctgcataaaattggtgcaggtacattgaatgttaatgtttctcaaggtaataatcttaaaacgggggatggtcttgtcgtattaaatagcgctaatgcatttgataatatttatatggccagtggtcatggtgttgtaaaaattaatcatagtgcagcgcttaaccagaacaatgactatagaggtattttctttactgaaaatggtggtactctggatttaaatggttatgaccagagttttaataaaattgcagcgacagatataggagcactcataacaaatagtgcagtgcagaaagcagttctttctgttaataatcagtcacactatatgtatcatggttctgtttcaggtaatacagagataaaccaccagtttgatacccaaaaaaataatagtcgcctgattctggacggtaatgtcgatattacaaatgacattaacattaagaatagccagctccaccatgcagggacatgcctacatctcatgctgtttttagagagggtgggggttacctgcatgctgccaggagttatttgtgaaaaggattatgtttcaggcatacagcaacaggaaaactcagccaataaaaataataatacagattataagaccaataatcaggtatcatcatttgagcaacctgactgggaaaatcgtctgtttaagtttaagacattgaatctgataaattcagattttatcgttggccgtaatgctattgttgttggtgatatttctgccaataattccactctgtctttaagtggaaaagatacaaaagtacatattgatatgtatgacggcaaaaacatcacgggagatggcttcggttttcggcaggatattaaagatggtgtatctgtttctcctgagagcagcagttattttggaaatgttacgctgaataatcactcattactggatattggtaataaatttaccggtggtatcgaggcttatgacagctccgtgagtgtgacctcacagaatgctgtttttgatcgtgttggcagctttgtcaacagcagcctgaccctcgaaaaaggagcaaaactaacggctcagggcggtattttcagcaccggggctgtggacgtaaaagaaaatgcctccctgatcctgacggggacaccttctgcacagaaacaggagtattactcccctgtgatttctacaacggaagggattaacctcggagataaggccagcctttctgttaaaaacatgggctatctgagttcggatattcatgcaggaaccacggcggcaaccattaatctgggagacggtgatgctgagacggattctccgttattcagctccctgataaggggatataacgcggttctgagtggcaacattacgggtgagcagagtacggtaaatatgaacaatgctctgtggtactctgacggaaactcaacgatcggaacgctgaagagtacggggggacgagttgaactggggggcgggaaagactttgccaccctgcgggtaaaagagcttaacgcaaataacgccacattcctgatgcataccaacaccagtcaggctgaccagctgaatgtcacgaataaactgttgggcagtaataataccgtcctggtcgactttttaaacaagccagccagtgaaatgaacgtgacgttaattaccgcaccgaaagggagtgacgagaaaacgttcactgcaggaacgcagcagattggtttcagtaatgtcacgccggtaatcagcacagaaaaaacggatgatgccacaaaatggatgctgacagggtatcagaccgtctctgatgccggtgcctcgaaaaccgcaacggactttatggcgtcaggttataaatccttcctgacagaggtcaataatctgaacaagcgtatgggtgacctgcgggatactcagggggatgccggcgtctgggcgcgcatcatgaacggtaccggttcggcagatggtggttacagcgataactacactcacgttcagattggtgccgacagaaagcatgagctggacggtgtggatttgttcacgggtgcattactgacctatacagacagcaatgcaagcagccacgccttcagtggtaaaaccaaatccgtggggggagggttgtacgcttcagcactctttgattccggggcttattttgacctgattggtaaatatctccatcacgacaatcagtacacggcgagttttgcgtctcttggtacaaaagactacagctctcattcctggtatgccggtgcagaggtcgggtatcgttaccacctgtcggaagagtcctgggtggagccacagatggagctggtttacggttctgtgtcaggaaaatcttttatctgggaagaccggggaatggccctgagcatgaaagacaaggattataacccactgattggccgtaccggtgttgacgtgggaagaaccttctccggagacgactggaaaattaccgcgcgagccgggctgggttaccagttcgacctgctggcgaacggagaaacggttctgcgggatgcatccggagagaaacgttttgaaggtgaaaaggacagcagaatgctgatgaatgtggggatgaatgcggaaattaaggataatatgcgttttggcttggagctggaaaaatcggcgttcgggaaatataacgtggacaatgcgataaacgctaacttccgttattctttctga

SEQ ID NO: 86 - DNA, 19 bp, Artificial Sequence
  Primer
gaacatcggaaggtggtgc

SEQ ID NO: 87 - DNA, 20 bp, Artificial Sequence
  Primer
gagaaaccgaatccttaagg

SEQ ID NO: 88 - DNA, 20 bp, Artificial Sequence
  Primer
ggatggttgtgttcagtgtg

SEQ ID NO: 89 - DNA, 61 bp, Artificial Sequence
  Primer
taactttctagattacaaaacttaggagggtttttaccatgaacagaatttattctcttcg

SEQ ID NO: 90 - DNA, 33 bp, Artificial Sequence
  Primer
cagtgaattctcagaatgaataacgaatattag

SEQ ID NO: 91 - DNA, 48 bp, Artificial Sequence
  Primer
gggagctcctgcggatccggcagcggtaatgatgccccggtcacgttc

SEQ ID NO: 92 - DNA, 38 bp, Artificial Sequence
  Primer
cggatccgcaggagctccccgcaagacttcctgcagag

SEQ ID NO: 93 - DNA, 51 bp, Artificial Sequence
  Primer
ctgggagctccgcaggatccggcagcggtaatactgcagggtatctgtttc

SEQ ID NO: 94 - DNA, 49 bp, Artificial Sequence
  Primer
ctgccggatcctgcggagctcccagaaccggcatagtccagcgtgatag

SEQ ID NO: 95 - DNA, 48 bp, Artificial Sequence
  Primer
gggagctcctgcggatccggcagcggtgcagacaaactggtgataaac

SEQ ID NO: 96 - DNA, 19 bp, Artificial Sequence
  Primer
gttcatcgaccactgggtg

SEQ ID NO: 97 - DNA, 54 bp, Artificial Sequence
  Primer
gggagcgggagctccgcaggatccggcagcggtaaccgcagttttacctttgac

SEQ ID NO: 98 - DNA, 48 bp, Artificial Sequence
  Primer
accgctgccggatcctgcggagctcccgctcccctgcagcgtcagacg

SEQ ID NO: 99 - DNA, 21 bp, Artificial Sequence
  Primer
gcaatctgaatgtggacaatc

SEQ ID NO: 100 - DNA, 52 bp, Artificial Sequence
  Primer
gggagcgggagctccgcaggatccggcagcggtagtgtcttcaacggcaccg

SEQ ID NO: 101 - DNA, 52 bp, Artificial Sequence
  Primer
accgctgccggatcctgcggagctcccgctcccgtcgcccagcgtgacgctg

SEQ ID NO: 102 - DNA, 51 bp, Artificial Sequence
  Primer
gggagcgggagctccgcaggatccggcagcgggtaccgcaatatctggagc

SEQ ID NO: 103 - DNA, 46 bp, Artificial Sequence
  Primer
gctgccggatcctgcggagctcccgctccctccgagggtgacagtc

SEQ ID NO: 104 - DNA, 19 bp, Artificial Sequence
  Primer
gtcatgacctgttgccgac

SEQ ID NO: 105 - DNA, 50 bp, Artificial Sequence
  Primer
ctgggagctccgcaggatccggcagcggtaaaagtgtcttcaacggcacc

SEQ ID NO: 106 - DNA, 50 bp, Artificial Sequence
  Primer
ctgccggatcctgcggagctcccagaacctgcaacagatgtgccttcttc

SEQ ID NO: 107 - DNA, 55 bp, Artificial Sequence
  Primer
gggagcgggagctccgcaggatccggcagcggtaccgtcaacctggataatcagt

SEQ ID NO: 108 - DNA, 56 bp, Artificial Sequence
  Primer
accgctgccggatcctgcggagctcccgctcccgccgttgaagacacttttatctg

SEQ ID NO: 109 - DNA, 30 bp, Artificial Sequence
  Primer
cggggagctccgtgatagcgggcgtcgacc

SEQ ID NO: 110 - DNA, 31 bp, Artificial Sequence
  Primer
tgccggatccgtgaaactggttcaatcccag

SEQ ID NO: 111 - DNA, 32 bp, Artificial Sequence
  Primer
cggggagctccatgtcgcaaatcatgtacaac

SEQ ID NO: 112 - DNA, 27 bp, Artificial Sequence
  Primer
tgccggatccgccgccccatttggcgg

SEQ ID NO: 113 - DNA, 27 bp, Artificial Sequence
  Primer
cggggagctccttctcccggccggggc

SEQ ID NO: 114 - DNA, 27 bp, Artificial Sequence
  Primer
tgccggatccgccggcgcctaacgaac

SEQ ID NO: 115 - DNA, 30 bp, Artificial Sequence
  Primer
cggggagctccaccggcagcgctgcaatcg

SEQ ID NO: 116 - DNA, 29 bp, Artificial Sequence
  Primer
tgccggatcccgacaagccgattgcagcg

SEQ ID NO: 117 - DNA, 64 bp, Artificial Sequence
  Primer
taactttctagattacaaaacttaggagggtttttaccatgaataaaatatacgcattaaaata

SEQ ID NO: 118 - DNA, 33 bp, Artificial Sequence
  Primer
gtcagaattctcagaaagaataacggaagttag

SEQ ID NO: 119 - DNA, 54 bp, Artificial Sequence
  Primer
gggagctccgcaggatccggcagcggtttaaaaaacaaatttactcaaaaagtc

SEQ ID NO: 120 - DNA, 42 bp, Artificial Sequence
  Primer
cggatcctgcggagctcccagcctgagatgcgcttaaaaaag

SEQ ID NO: 121 - DNA, 20 bp, Artificial Sequence
  Primer
ccagagccaatgtttacgtc

SEQ ID NO: 122 - DNA, 30 bp, Artificial Sequence
  Primer
gtacgaattcgtgcgtaacggcaaaagcac

SEQ ID NO: 123 - DNA, 30 bp, Artificial Sequence
  Primer
gtacgtcgacacatgagcagatcctctacg

SEQ ID NO: 124 - DNA, 25 bp, Artificial Sequence
  Primer
agaaaaacucatcgagcatcaaatg

SEQ ID NO: 125 - DNA, 23 bp, Artificial Sequence
  Primer
atgagccauattcaacgggaaac

SEQ ID NO: 126 - DNA, 31 bp, Artificial Sequence
  Primer
agtttttcuaactgtcagaccaagtttactc

SEQ ID NO: 127 - DNA, 37 bp, Artificial Sequence
  Primer
atggctcauactcttcctttttcaatattattgaagc

SEQ ID NO: 128 - DNA, 23 bp, Artificial Sequence
  Primer
atctttcugcgaattgagatgac

SEQ ID NO: 129 - DNA, 20 bp, Artificial Sequence
  Primer
aagcctaguctcatgagcgg

SEQ ID NO: 130 - DNA, 32 bp, Artificial Sequence
  Primer
actaggctugtaatcatggtcatagctgtttc

SEQ ID NO: 131 - DNA, 30 bp, Artificial Sequence
  Primer
agaaagauagacgaaagggcctcgtgatac

SEQ ID NO: 132 - protein, 91 aa, bacteriophage phi-X174
MVRWTLWDTLAFLLLLSLLLPSLLIMFIPSTFKRPVSSWKALNLRKTLLMASSVRLKPLNCSRLPCVYAQETLTFLLTQKKTCVKNYVRKE

SEQ ID NO: 133 - DNA, 295 bp, Artificial Sequence
  Synthetic DNA fragment encoding Lysis protein E
gaattcaccatggtacgctggactttgtgggataccctcgctttcctgctcctgttgagtttattgctgccgtcattgcttattatgttcatcccgtcaacattcaaacggcctgtctcatcatggaaggcgctgaatttacggaaaacattattaatggcgtcgagcgtccggttaaagccgctgaattgttcgcgtttaccttgcgtgtacgcgcaggaaacactgacgttcttactgacgcagaagaaaacgtgcgtcaaaaattacgtgcggaaggagtgataagggatcc

SEQ ID NO: 134 - DNA, 30 bp, Artificial Sequence
  Primer
gcgcagtactttgcgccattctatggtgtc

SEQ ID NO: 135 - DNA, 32 bp, Artificial Sequence
  Primer
gcgcagtactcacagcatcagaatgaataacg

SEQ ID NO: 136 - DNA, 20 bp, Artificial Sequence
  Primer
tataacccttgtcgccgttg

SEQ ID NO: 137 - DNA, 20 bp, Artificial Sequence
  Primer
acgcagcaaggtcgatttac

The invention claimed is:

1. A Gram negative bacterial host cell capable of expressing more than one POI (polypeptide of interest), the host cell comprising a fusion protein or a nucleic acid encoding a fusion protein, said fusion protein comprising said POI:s and i. a passenger domain comprising a beta stem domain from an autotransporter protein belonging to the pfam autotransporter family PF03797, wherein the beta stem forming sequence of the passenger domain is essentially intact;

ii. a translocator domain from an autotransporter protein belonging to the pfam autotransporter family PF03797; and iii. a signal peptide being able to target the fusion protein to the inner membrane of Gram negative bacteria;

wherein the passenger domain of the autotransporter in its native form comprises at least two side domains, and wherein at least two POI:s are inserted into, replace or partly replace a separate side domain.

2. The Gram negative bacterial host cell of claim 1, wherein the fusion protein, when expressed, is displayed at the cell surface.

3. The Gram negative bacterial host cell of claim 1, wherein he fusion protein, when expressed, is secreted and released from the cell surface.

4. The Gram negative bacterial host cell of claim 1, wherein the passenger domain in i) and the translocator domain in ii) is derived from a SPATE (serine protease autotransporters of Enterobacteriaceae) protein.

5. The Gram negative bacterial host cell of claim 4, wherein the SPATE protein is Hemoglobin-binding protease (Hbp), extracellular serine protease (EspC) or temperature-sensitive hemagglutinin (Tsh) from *Escherichia coli*.

6. The Gram negative bacterial host cell of claim 5, wherein the SPATE protein comprises a polypeptide with a sequence that is at least 90% similar to SEQ ID NO 1 or SEQ ID NO 2.

7. The Gram negative bacterial host cell of claim 6, wherein amino acids 53-308, 533-608, 657-697, 735-766 and 898-922 of SEQ ID NO 1 or SEQ ID NO 2 correspond to side domains, and wherein the POI:s are inserted into, replace or partly replace at least two of such side domains.

8. The Gram negative bacterial host cell according to claim 1, which is selected from the family of Enterobacteriaceae, such as *Escherichia coli, Salmonella* spp., *Vibrio* spp., *Shigella* spp., *Pseudomonads* spp., *Burkholderia* spp. or *Bordetella* spp.

9. The Gram negative bacterial host cell of claim 1, wherein at least one of the POI:s comprises an antigen.

10. The Gram negative bacterial host cell of claim 9, wherein the antigen is an antigen from *Mycobacterium tuberculosis*.

11. The Gram negative bacterial host cell of claim 10, wherein the antigen from *Mycobacterium tuberculosis* is selected from the group consisting of ESAT-6, Ag85B, Rv2660c, TB10.4 and TB10.3, or a protein that is similar to those proteins.

12. The Gram negative bacterial host cell of claim 11, wherein the antigen is Ag85B that has been split into a N'-part (Ag85B(N')) and a C'-part (Ag85B(C')), and wherein each part is fused to a separate side domain of a passenger from an autotransporter protein belonging to the pfam autotransporter family PF03797.

13. The Gram negative bacterial host cell of claim 11, wherein at least two of the antigens ESAT-6, Ag85B, Rv2660c, TB10.4 and TB10.3, each either split or in full sequence, are fused to, inserted into, replace or partly replace a separate side domain of a passenger from an autotransporter protein belonging to the pfam autotransporter family PF03797.

14. A vaccine comprising a Gram negative bacterial host cell according to claim 9.

15. A fusion protein comprising
  i. more than one POI (polypeptide of interest)
  ii. a passenger domain comprising a beta stem domain from an autotransporter protein belonging to the pfam autotransporter family PF03797, wherein the beta stem forming sequence of the passenger domain is essentially intact;
  iii. a translocator domain from an autotransporter protein belonging to the pfam autotransporter family PF03797; and
  wherein the passenger domain of the autotransporter in its native form comprises at least two side domains, and wherein at least two POI:s replace or partly replace a separate side domain.

16. The fusion protein of claim 15, wherein the passenger domain in i) and the translocator domain in ii) is derived from a SPATE (serine protease autotransporters of Enterobacteriaceae) protein.

17. The fusion protein of claim 16, wherein the SPATE protein is Hemoglobin-binding protease (Hbp), extracellular serine protease (EspC) or temperature-sensitive hemagglutinin (Tsh) from *Escherichia coli*.

18. The fusion protein of claim 17, wherein the SPATE protein comprises a polypeptide with a sequence that is at least 90% similar to SEQ ID NO 1 or SEQ ID NO 2.

19. The fusion protein of claim 18, wherein amino acids 53-308, 533-608, 657-697, 735-766 and 898-922 of SEQ ID NO 1 or SEQ ID NO 2 correspond to side domains, and wherein the POI:s are inserted into, replace or partly replace at least two of such side domains.

20. The fusion protein of claim 15, further comprising a signal peptide that targets the fusion protein to the inner membrane of a Gram negative bacterium.

21. The fusion protein of claim 15, wherein at least one of the POI:s comprises an antigen.

22. The fusion protein of claim 21, wherein the antigen is an antigen from *Mycobacterium tuberculosis*.

23. The fusion protein of claim 22, wherein the antigen from *Mycobacterium tuberculosis* is selected from the group consisting of ESAT-6, Ag85B, Rv2660c, TB10.4 and TB10.3, or a protein that is similar to those proteins.

24. The fusion protein of claim 21, wherein the antigen is Ag85B that has been split into a N'-part (Ag85B(N')) and a C'-part (Ag85B(C')), and wherein each part is fused to a separate side domain of a passenger from an autotransporter protein belonging to the pfam autotransporter family PF03797.

25. The fusion protein of claim 23, wherein at least two of the antigens ESAT-6, Ag85B, Rv2660c, TB10.4 and TB10.3, each either split or in full sequence, are fused to, inserted into, replace or partly replace a separate side domain of a passenger from an autotransporter protein belonging to the pfam autotransporter family PF03797.

26. A vaccine comprising the fusion protein according to claim 21.

27. An outer membrane vesicle displaying a fusion protein according to claim 15 on its surface.

28. A bacterial ghost displaying a fusion protein according to claim 15 on its surface.

29. A nucleic acid arranged for expression of a fusion protein, said nucleic acid comprising, in frame:
  i. sequence encoding a signal peptide of said fusion protein, the signal peptide being able to target the fusion protein to the inner membrane of Gram negative bacteria;
  ii. sequence encoding a passenger domain of said fusion protein, the passenger domain comprising a beta stem domain from an autotransporter protein belonging to the pfam autotransporter family PF03797; and
  iii. sequence encoding a translocator domain of said fusion protein, the translocator domain deriving from an autotransporter protein belonging to the pfam autotransporter family PF03797,
  wherein the sequence encoding the passenger domain of the autotransporter in its native form comprises at least two stretches of sequence encoding side domains protruding from the beta stem domain, and wherein the sequence encoding the passenger domain comprises at least two stretches of cloning site sequence that allow in-frame cloning of at least two DNA sequences that encode POI:s (polypeptides of interest), said at least two stretches of cloning site sequence being inserted into, replacing or partly replacing separate stretches of said stretches of sequence encoding side domains and said stretches of cloning site sequences being arranged such that the encoded beta stem forming protein sequence of the passenger domain is essentially intact.

30. A nucleic acid arranged for expression of a fusion protein, said nucleic acid comprising, in frame:
  i. sequence encoding a signal peptide of said fusion protein, the signal peptide being able to target the fusion protein to the inner membrane of Gram negative bacteria;
  ii. sequence encoding a passenger domain of said fusion protein, the passenger domain comprising a beta stem domain from an autotransporter protein belonging to the pfam autotransporter family PF03797;

iii. sequence encoding a translocator domain of said fusion protein, the translocator domain deriving from an autotransporter protein belonging to the pfam autotransporter family PF03797; and iv. sequences encoding more than one POI (polypeptide of interest) of said fusion protein, wherein the sequences encoding the POI:s are fused to the sequence encoding the passenger domain and are arranged such that the encoded beta stem forming protein sequence of the passenger domain is essentially intact, and wherein the sequence encoding the passenger domain of the autotransporter in its native form comprises at least two stretches of sequence encoding side domains protruding from the beta stem domain, and each of the sequences encoding POI:s are inserted into, replace or partly replace separate stretches of said stretches of sequence encoding side domains.

31. The nucleic acid of claim 29, further comprising sequence encoding for a cleavage site that allows for secretion of the encoded fusion protein from a Gram negative bacterial host cell harboring said nucleic acid.

32. The nucleic acid of claim 29, comprising no sequence encoding for a cleavage site that allows for secretion, or comprising a disrupted cleavage site, such that the encoded fusion protein is arranged to be displayed on the cell surface of a Gram negative bacterial host cell harboring said nucleic acid.

33. The nucleic acid of claim 29, wherein the sequences encoding the passenger domain in ii) and the translocator domain in iii) are derived from a gene encoding a SPATE (serine protease autotransporters of Enterobacteriaceae) protein.

34. The nucleic acid of claim 33, wherein the SPATE protein is Hemoglobin-binding protease (Hbp), extracellular serine protease (EspC) or temperature-sensitive hemagglutinin (Tsh) from *Escherichia coli*.

35. The nucleic acid of claim 34, wherein the gene encoding the SPATE protein encodes a protein sequence that is at least 90% similar to SEQ ID NO 1 or SEQ ID NO 2.

36. The nucleic acid of claim 35, wherein amino acids 53-308, 533-608, 657-697, 735-766 and 898-922 of SEQ ID NO 1 or SEQ ID NO 2 correspond to side domains, and wherein the cloning sites or the sequences encoding POI:s are arranged to replace or partly replace at least two of such side domains.

37. The nucleic acid of claim 29, wherein at least one of the POI:s comprises an antigen.

38. The nucleic acid of claim 37, wherein the antigen is an antigen from *Mycobacterium tuberculosis*.

39. The nucleic acid of claim 38, wherein the antigen from *Mycobacterium tuberculosis* is selected from the group consisting of ESAT-6, Ag85B, Rv2660c, TB10.4 and TB10.3, or a protein that is similar to those proteins.

40. The nucleic acid of claim 37, wherein the antigen is Ag85B that has been split into a N'-part (Ag85B(N')) and a C'-part (Ag85B(C')), and wherein each part is fused to a separate side domain of a passenger from an autotransporter protein belonging to the pfam autotransporter family PF03797.

41. The nucleic acid of claim 39, wherein at least two of the antigens ESAT-6, Ag85B, Rv2660c, TB10.4 and TB10.3, each either split or in full sequence, are fused to, inserted into, replace or partly replace a separate side domain of a passenger from an autotransporter protein belonging to the pfam autotransporter family PF03797.

42. A vaccine comprising the nucleic acid according to claim 37.

43. A vector comprising a nucleic acid according to claim 29.

44. A Gram negative bacterial host cell comprising a nucleic acid or vector according to claim 29.

45. A method for secretory protein expression of a fusion protein, comprising the steps of i. Providing a Gram negative bacterial host cell according to claim 1;

ii. Inducing expression of the fusion protein.

46. The method of claim 45 comprising the additional step of inhibiting a periplasmic enzyme with protease activity in the host cell.

47. The method of claim 46, wherein the enzyme is DegP.

48. The method of claim 47, wherein DegP is inhibited by a mutation in the catalytic site of DegP.

49. The method of claim 45 comprising the additional step of down regulating at least one enzyme that catalyzes the formation of disulfide bonds in proteins in the periplasmic space of the Gram negative bacterial host cell.

50. The method of claim 49, wherein the enzyme is DsbA or DsbB.

51. The method of claim 45, wherein the fusion protein is secreted in a soluble manner.

52. The method of claim 45, wherein the fusion protein is displayed on the cell surface.

53. The method of claim 45, wherein the method comprises the additional step of inducing shedding of vesicles from the outer membrane of the Gram negative bacterium, thus forming outer membrane vesicles displaying the fusion protein on their surface.

54. The method of claim 45, wherein the method comprises the additional step of lysing the Gram negative bacterium to form bacterial ghosts displaying the fusion protein on their surface.

55. The method of claim 54, wherein the lysing is made by use of the lethal lysis gene E from bacteriophage PhiX174.

56. The method of claim 45, wherein at least one of the POI:s expressed by the host cell comprises an antigen.

57. The method of claim 56, wherein the antigen is an antigen from *Mycobacterium tuberculosis*.

58. The method of claim 57, wherein the antigen from *Mycobacterium tuberculosis* is selected from the group consisting of ESAT-6, Ag85B, Rv2660c, TB10.4 and TB10.3, or a protein that is similar to those proteins.

59. The method of claim 56, wherein the antigen is Ag85B that has been split into a N'-part (Ag85B(N')) and a C'-part (Ag85B(C')), and wherein each part is fused to a separate side domain of a passenger from an autotransporter protein belonging to the pfam autotransporter family PF03797.

60. The method of claim 58, wherein at least two of the antigens ESAT-6, Ag85B, Rv2660c, TB10.4 and TB10.3, each either split or in full sequence, are fused to, inserted into, replace or partly replace a separate side domain of a passenger from an autotransporter protein belonging to the pfam autotransporter family PF03797.

61. A method for preparing a vaccine comprising expressing a fusion protein from a host cell using the method according to claim 45 wherein at least one of the POI:s expressed by the host cell comprises an antigen.

* * * * *